United States Patent 10,407,724 (METHODS AND COMPOSITIONS FOR SCREENING AND TREATING DEVELOPMENTAL DISORDERS) - sequence listing, part 21

SEQ ID NO: 549 - DNA, 34533 bp, Homo sapiens
acaatttgtgttctgctcatttagcagcatctcatgacattcaacctctgtctgtcccttgcaggatggagaagaacattcttacatgctggtgagtgcctctgatgctccctcagatctcagctttctcccgctagccagctaacaggactccttagaggagatgagcaaggggcccagggctacacagggatagcagggaattggggtcagttcatcaacagtgtcccagcaatgatgcatcatggctcttctgtcagagaatcccagcagctctcaatccaccgtggtttacatcccaggatcctttctcttttggaataatttaatacatgattaccagaggtttccatatatagtagcctccccaagacttatgcttcagtggtttttgctctttgattctggatcagtttgaaagaagacaatgctgtcttagcaatttatatactaggaatgatgtagactgtgcatagttgaaggcacatgttggcaagaggctataaaggttcccaatcagcttgacagaatggtatacaaataactggccagaaatgcctttctgctcttaagagaacacctatactttgtgtatatatagcctgccaggggagggggttcgggtgggtgggagagcacagaacccaattgcccactcccaatgggcacttcccatcttatgattgagcccctctgcccataagcaccacagaatccaagcttcaccagataccatggcacacggacccttcctctttaggtgaatttcaaaattgccactgtcaacttgggaccaaatagcaaaatgtcacaaccagacatattaacttggggaatggaggaaatcattttaacacaatagaaaggtagactaaataagtaagaataaatgtagatgggggaggccggcagaatgcccggagtctggagcatttcttgcactgacaggaaatgtacctaggtaggcacctacatttcctgtacctacctatatgttctttccccagttcttttagcagtttctttcctttcctattcaaatcccttttccctagacagaatcttttcttccttttggagtttgttgatctaataggtatacagaagtcatacctgcagacatcagacccatgttgttgaagcaaaactggatggaaatagttcctccatacctttgcctacagacccctcaggcagtaggttttcttttggggacatttatttttctcctttatcctcgaagggtgccctcgtcagtcatttaaatcagttgtcatctggtaaaaggaacacataggaccaacgaagaaaccctttatcctccaggacagtgtgaagggaaagactcaccttagttgatccaatggggagaggaggagcaggacataaagcctctgtgctggtttgagccaagttggaaagtttctaactaaagaaagtcccagagatcataggtcttgaatagaaaagggaatagattttagaatgctaaaattgtgaatgattaatttgggctcattccccaaattctctggatttcataaagcctcagttcttctcaacctgagggtgctgcttactgtctctggagagacagaaatgcagcttcagaggccaggatggtggctcacacctgtaatcccagcactttgggaggcagaggtgggaggatcaactgaggttgggcattcgagaccagcctgaccaacatggagagaaaccctgtttctactaaaaatataaaattagccaggcacggtggcacatacctgtaaccccagctccttggggggctgaggcaggagaatcacttgaacccgggagacagaggttgcggtgagccgagattgcaccactgcactcaggcctggcaacaagagcaaagctcagtctcaaaaaaaaaaaaaagtgcatcttcagtaattctcgggtatgagctgcctgggatcagggggccttcgtggaaatggcccctacatggggatcccgctgcagctttctgagacctctcagggcaccaggaaccacacagagttcctgagacttcctctgcagccaatgttgtcctggaccaagacactggtcatccctatctcttcgtgtcagaggacaaaagaagtgtgacattggacccctccagggagagcattccgggcaacccagagagattcgacagtcagctttgtgtcctgggccaggagagcttcgcctcagggaaacattacttggaggtagatgtggaaaatgtgattgagtggactgtggggatctgtagagacaatgttgagaggaaatgggaggtcccactacttcctcagaatggcttctggaccttggagatgcataaaaggaaatactgggccctgacctcccttaagtggattctctctctggaggagcccctttgccaggtgggcatcttcctggactatgaagctggagacgtctccttctacaacatgagggacagatcacacatctacacatttccccattcagccttttctgtgcctgtgaggcccttcttcagcttagggtcttatgacagccaaatcttaatctgctctgcattcacaggagccagtggggtcacggtgcctgaagagggctggacacttcacagagcagggacccaccacagcccacagaatcagttccccagtctcacagccatggaaacaagccctggccatctcagcagccactgcacaatgcctctggtggaagacacgccctcctcccctctggtcacacaagagaacatcttccagctgcctctttcacacccactccagacctcagcccctgttcacctcctcattaggtgtggctttagtagttcctttggttgtaactatgggatggaatccaggcatagggaactagttgttccacagctcccagccaggaagaaagtgtgagaagctgattggtagtgaacctgctgtttaacatcacagtgactacattgaacccagtatgccagttggcaccagatgctgtggacttggaatgaggccaagaggagtcgccaggatgtgagaggagagaggaatccacaggaccaccagagggtgagtgaaccagatatgcaggtcagagatagacgaagtggaaccagagagctgggagggaccaaggttgtaagggtgcttaagccccaccataacagctaaggagtcccaggagatgatggctcatttccacccaaccccaggatttccacagcacacacccacaggcctggacctgggacgaagatgaatgaagaatatggacatgtggatgtggtttggctcacgtgtccctgcaataaacaaggagtcagtactcagtccttgggtgtggttgaggcttgaggtcctgattgagcaaggcagtactggacaaggtctacatcagcattcaagttcaatggggggcactagtggcttcaaacttcctggtctaattatgtctttagacacttaataactactgagggccttgaggagctcttgtttatttgggttgatatttgttaatatttatggcatttgacattaaaacagaaaatgttaaaatgttatttactaattcatgttaaaatataatgaatgaaccaaatgtaggttaatataaatagaatgctttctgaaaaatcaactgttgtgtccaaacaaaaaaacaagaagtgtgacactggttaacttgtttcaaatctgatgtctggcttaatggaagatgtttgtattctcatatctgcttttgtattaaatctgttggtatatcataccctaccaagagaatgagatcaaaaacaacaaatgttatattatgatgatgatgatgatgaaaatagtattaagattggggactccttaggagtatatcagagttctccctagacatccccagaccatgtttggaatagtggatcctggaagtgaatccatgagctgcttaattttaggtgtcaacttgactggattacggaatacctagacaactggtatattatttctggatgtatttgtgagtgtgtttccagaagagattgacatgtgagtcagtgggaaattctcccctcctattggctgggggcccaatataacaaaaaggcagaggaaaggcaaattcttctctcccctgagacattcttcttctgctgctcttggacatcagaactgctggctctcgggcctttgaactttgggacttgtaccaggaagccctgggttctcaggcctttcactttggactgagatttacacaatcggcttccctagttctgaggctttcagacttaaactgagccatactaccagcatcccagggtctccagcctacagacgagctgtcatgggatttctcagcttgcataatcacatgagccaatttccctaataaacacccgctcatcatatgtatctatatctatatggtattggttttgtttctctggagaattctgactaatacaatcaggcatctaaaattctgacttgaatggtagtattttaggtttgagacaattcaataatccaacaggaatgaaaaaaatttaaatagtccaaaattgtattactgcagttacaaaaaggcacattattgaaagaatccagagttgttgcaggaagtcagggaccccgaatggagggaccagctgaagccatggcagaaaaacttaaattgtgaaaatttcatggacatttattagttccccaaattaatacttttataatttcttatgcctgtctttactgcagtctctgaacataaattgtgaagatttcatagacacttatcacttccccaatcaatactcttgtgatttcctatgcctgtctttgctttaatctctttatccctttatcttcataagctgaggataaatgtcgcctcagggccctgtgatgattgcgttaactgcacaaattgtttaaacaatatgaaatctgggcaccttgaaaaaagaacaggataacagcgatgttcagggaacaaaggagataaccttaaggtctggctgcctgtgggccgggcagaacagagccatatttttcttctttcaaaagcaaataggagaaatattgctgaattctttttctcagcaaggaacatccctgagaaagagaatgtgttccgaaggggaggcctctgaaatggctgctttaggaacgtctgtcttttacagttgtagataagggatgaaaaaagtcccggtctcccgttgcgctcccaggcttattaggaagaggaaattccctcctaataaattttggtcagaccggttgtctgctctcaaaccctgtcccctgataagatgtcatcaatgacaatgtgtgcctgaaacttcattagcaattttaatttcaccccgtcctgtgatcttgccctgcctccatttgccttgtgatattttattaccttgtgaagcatgtgatctctctgacccccaccctattcatacactccctccccttttgaaaatcactaataaaaacttgctggttttgtggcttagggggcatcacggaacctgccaacatgtgatgtcttccctggacacctagctttaaaatttctctcttcgtactctttccctttatttctcagaccaggtgacacttaaggaaaatagaaaagaacctatgaagaattatcgggggcgggttcctccgatacagagtgattctttcaacctctggggttgagggccagatcatatatgcccctgaaagtcatcatgctaacctgggctttacctgtgagaggggagccactggaaggcttggcagaaaaaaaaactggacttacttcagatgctagaccaagatgggctatgtgtaggggtggtggatggaagcctgaagacccagctgggagctactgcagtgatccagaggggagatgccgatgacttgtaccagggaggagccatggaatgatctgatgctggatttattttcaagacagagtaaaaaggctttgctggtaaacctaaatgtgctgtgtgaaaaaggaggacatcaaggatgaccataaggttttaatcctaagaaatggtacagatggagttgctacttatggagatgaggaaactgagggagaagtccattttggaggccagaggaggagccagcatagaatccaaggtcagttttggatacgttcgggttgaggagcttactagagatccccgtggagatgcagagtaggcaggtcaataataaatgtgcatgccaggcacagtggctcatatctgtaatctcagcacattgggaagccgaggcaggtggatcacctgaggtcaagtgtttgagaccagcctggccaacatggcgaaatcccatctctactaaaaatacaaaaattagatgggtgcagtggcatgcgcctgtaatcccaactactcaggaggctgagatagaagaatcacttgaacctgggaggcggaggttacagtgaaccgagattgcaccactgcactccaacctgggagacagagtgagactccatctcaaaaaataagtaaataagtaaataaataaaatgatagcaataacaattaatgtgcagtccaggcaacaggtcagggctggaaacacaagttattctttctgtattctgtatcttcatgattgttgccactgcctgtttcaatttaatgcattagtgatctattgctgcttaacaaattactgcaaacttagtggttcaaaacagcagacatttgtcattttagtttctctgggtcagaagtccaggcagaccttagatggcttctctgctcagaactttacaaagcaaaagtcaaggtgttggccaggctgtatgtagcctcatcttgtcttgactgtgggagagtcctcttttcagatcactcaggtcattaacagaattcatttctttacagttgaaggactccctgcaggctgaagctggaggctgctctaagctcctacaggccacctcagctccttgctatgtgggtctccaacgatgactacttttgtcttcaaagccagccaggaagacagagactctagagtgggtcagctagcaagacagagtcttacactacattatgtagtcatggaagggacatgccatcagctttaccatattttattggttagcagtaagccataggttcagctcacactcagggaaagtacaggctgcaaactgcaagaggagtaatcataaggggtccactccagagtctgtaggctacaccatatacaagctcaaggttctcccactgtaactgccctgcttcccctttcccagggcaatacaccacacttgcctttctctaggtctctacttccatgaaagcaaagtctcagaaagagaacacatgcatggccgtcaggcactgtttgccatgatgatggccactgctgtaccacaccataaacattgttttacagttactagtggattcccaatcattaaatccattatacatttctattttcccctcccaccgccatgctttttttttttttttttttaagagagataggatcttgctctgtcaccccccaggctagaggtcagtgacgtgatcatagctgagtgcggccttgatctcctgggctcaagtgatcctcctgccttagcatcccatagtgctgggattgtagctgtgagacactgggccttgcttgtctttatacacctctgtcctttctttatggacaaccctgagttcttcatagacctgcctgagtaggtgttcctgcctatgtggcatctgcctcatcaatccccagggccctcttcttggtctttccctgctcctagggagatctttctcagaattcttgctccacttgctccagaactgctgaaattccttaggctttggtcctgggctctcatttcacaccacatatactcatatggtccaatccattttcagagcagacccccactggcacctatcccataagcagacccccactggcacctgtacttctgtctccagccccacacattccctgaactcagtgcccactaggcatctcacaatgagtgtatccaaaataaaattcccatcaaccctgcctacccatcatcatctgaatgactgacaccacctaagagtcattttagccttctcttgttctctcttaacccaccacatccgactgatagccaagccctgctatttgtacttcctttcaatagtccagcttagtggtttgatcaaagactctggagtgagacagcctgggctcaaggcccagctcagaaagaaactacttgtgtgaccttgggaagtcatttaacctccctggacctcagcttttacgtctataaaatgtgggaaataaggtacctcttagtgttgttgtgaatcttgttaatatatgtaaatctctaagcacaatactagcattgtagcaggttctatgtaagtatttcctagtattaatgtgagtaatcaatcaagtcccctctcctccattgccaagctgccatcatttcttgcctagagtgtcacagtagcttcctttctggtctccctatctcctaacgtgtggcccaccggatgaggatgggatatattgtgcaaccccagcaggcatcatcccatggaatacaatgtaaaaggtgccccctacctcccatcttccctggcacctgccccactgctattttcagtgtacacattttctcacgtcatacttttcagatattttcccttcaccttcacactaaaactccaactcacagcaggcaactgtcgatgttttctccaggggaggtggatttaggagtcatcaatgcagggatcagaattaagcctttcagaatggaagacaatgaaattcatttagggttaatacatgcaggtgctgtgctaactcttccttaaataacttatggaccatgtctcatttccactatagacaaagaaacagaaacattgagtgattagttaaccagctttgggttccagggctaatgagttgtgcatgacaacagatgaagatagaaaaaaaaaagcctagagagagtagatagtaagccagtgtgcctgggacatgctgacagatatctagatgtagcataaagaaaatttgtgttcatgggaggtcctaatggcagcaagaggtgagataaccatgagaaatggacatttcttggtgagactaactcgataaaggagacaaatctctgggcattttgccacacctactgcatgcaggacactgcactagatcttataaaagataaagagaagatagcatcaagtgcctaggtcttgaaggagggctgagtgcacttttcatttagcgtacattcttatgacttacttttttatcatacactgttgtaagcaaactgcatgtgttgtctcattccatgctcacagcaacaactcttaaaagtcaagtactattactgtcattattttacaggtagggaaactggggcacaaagaagttagagaactggccaaaggtcacacaggccacctggcttcagaattagtgctcttatccactctattatgcaacctctcctcactagttttgaacttcagtggctgagacctactacatggtaggttctcaataaaaatttgttgaatcactgaattcatttctgccccatttcacatccatttctttcccaagacttctttgtcagagttcggtataaaggactgatgagaaatggacccagggcctcacactttggaaactacaaagttcaacgatacaaactattggtcccagaaactcctaatctgaagcttagcacctcagctgctgtgtcaaaaatgacttggatccttcaggcaagggtggggtgatcattcttactgatataatttcaagcagcacagcttctgatagactgtgaatttaaaaatgagcaaatgggctgggctcagtggctcatgcctgtaatcccagcactttgggaggccgaagcgggcgtatcacctgaggtcaggagtttgagatcagcctgggcaacacggtgaaacccagtctctactaaaaatacaaaattagccgggcatggtggcacatgcctgcaatcccagctactcaggaggctgaggcaggagaatcgcttgaaccttcggagccggaggatgcggtgagccgagatcgcaccattgcactccagcctgggcaacaagagtaaatctccatctcaccaaaaaaaaaaaaagaaaaagaaaagaaataaaaatgagcaaatgaacatttaaataaataagtatgatggataaatagggaatgaacagtggtatggattataataaagtaagaaagtttcgtaaaatattaagtatatcactataatctacatggtaggcatattggtattcaccaaaaattctttcacctttgctttatgttttagaagtgttatggtaaactgttgggaaggaaaagggggagggaagaattgtgggattctgttggtaacagagaccagaaataccattggcttaaacaaaacaagggttttcttgttttttcttgatgttgttgtttgttttcatgtaaaatgaatttagatggcggtagtccagggctgacctggcagctcagagatgtcattcatgccccagcctgcttctgacttcattctctgctgtctctgcatgtggctttcaacctcaaggttgcctcatggttctaagagggctgccgcacctctagttcaaaagtctacatccaagacaagaggaagaaggaagtacggagagtgtacactcacactcccagctatcttggcctccattctgaaggatctctgggagaaacacaagcccacaactttacctacaaactattgattccaacttagtcccttgttctctggtatctatgagatagcagagcctattgaagtacccaagaaaattaggctttatcaccaagaagaaagggggactgcatgatgcagaagggaccagccatctcaaccagatactgcacagcctaaattcaaactgttacaatataatcaaatttcatcaaccccagtcacatcttaatcttaggagttttgatcactgacttgcaaatccaaaaagtgtgttttgaggtcctaggccacaggaagaaccagtttgtctcacagacctcttacagagatggcatttgtagtctatctagattccagcttcagataatatgtactccactggcagcacgagaaataaatacacaggaaaatacaatatagcacaaaccaggagctgagggcgaatgaagatgctcagaaacacctgcactaaaagtttcctgaaaaaggtaaaaaatgtcaatcagcactgcctctggaaaccagaaacattatattatttgataacagatcctaagtctggatgctggaggtgcttaaaaatgtgcattgcgtctggctttctttccatgtatacatttatttgacgctgtagtaaaatctcctccttcaggtacccatattcatgcaagcaaatgttagcaaactgccacagtagcattttaattagtgcacaactttctctcttcaccacattataatcttttctcattttgttctgctgctatttctattatgataaaagacttaagtaaatatgtagaaatacttatatacatggacacgcaataatgattcaaatagataaacacagaaacacaaacactaagggaggtacggctggaatttttctgcaacgtgtacaattcaatgtactttcacttttcatttcaaccctcctcagtggtttcctcccagcaactgatgagaaacatcacctctgagccaatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtggtgagtgggcatgcagggagagtacttgcccagggaaaggggtgcagtgcctctgtgtgtgtgtgtgtgtgtgtgtgtgtgtgtgtgtgtgtgtgtgcgtgtgtgcgcatgggcacccatgcacacatgtgggcacatggagaagaggcaagtagtgcaaagaataaagacctgcagatattgggatttggtggaaggagagggagacaacataaatgaagaaatattccaactgcatgttcttaagaacttattgtggtcagaaaagggcaaaaaagtcgctaaaatctgttttggccaacacaagccatctattctaagagattctagaaagagatgtgccttatagattcatatgtaaatttgttcattacagaaatacttataatatagaaaaatctgaaccagcatacacatacaacaggcagggggtagacaaacagtgcgtggctctatcataaaagagatttctatgcagcttttaggcatcatgtttttaatgaagggcaattatttctcattttaacagcattagatccatacattaaaccttgttttgtatgttttaggtacagtatctgtttttccttccattaatcatttcctcataacccaatatatgtgtttcaatggacacaatctatttcattgtgtgaatatataattattttgtaatactttactaattttggctatttcaattatctacatttggctactgtatagattttattatatttaacaacctcagacataaatttttgtcttaatttctgtcttttttttttgcctcaacaataattcctataagtggaacttttgggtaaagcatacaacttttttttttaatagcatttccttggtagagcatgtaactttttaaagatgcttgctgtatatatgaccaaaatgctttgagaaatatttatatttctactaccaaagtatatgattactactacagagttttaattttattgattgactaatttgtagaaatgggggtctcattatgttacccaggctgttttaaacccctgggctcaaggaatcctcccaccttgaccatccaaattgctaagattgcaggcatgagccactgaacttttattcctttatgcttttcttcatttgcaatattgactataatcaggaagaaaatataaacatcctttaaaaagaatgaaaacatatgtctcactctaagcagagcagagaaattgttaactttgaaaccagtgataataaaaatgataccccttctatagcaacataaagagaagttttgaggaacagaagatgtgaaatgcaatatttagtctgggtcagtgcaagatccaggcgagggtggaggatggccggctgcacagacctctgttccggtgctttctcttcatccctccccacctccctctgcagaccttgttctcagaggccattcccagactcaggtagctacagcagcgggtgttgtggctgcaggcctcatgctcctttgctttggaagaaactgttgaggagttagtatttactgagcagcttatatgttccagtcagtattatcactcataataattactgttaagtaatacatgaaaaatcttaaatttaaagcatttcaatattttaaaagtaaagggagcaaaaggccaacgtgttcttttgctcacttaacttccgatcttcagtttagcatgcatctttttagactttttcaggcgtttacatctataaatatgcagaaatgtatagctttgtttttgtttttcagttgaatcattagtgtagttctgcaacatgctttttgaccgcttagtgtatcaccattatctaggttcatgacaataaatcaactctttttacctgctgcattgaattccctctgagggatgagccgtagttcctctaaacagtctcctgttgggtggctggttcagtcggttaccacttttatactttaaaaacagtgctgcagtgtcattctcacagaggcttctctctgcactcatgcaagtactttgctagactagacatcagaaagtggaattgctggacccaattgtgcacattcgaaatttcacacttcatgatattgtatgaatcaataaagttccaatggttttgtcccatgaacaagatcacacagcttgtgaatcttagagcctttacctattgcttaccttctttatgtccttaacactaatatagtaggcctcacccattgtgggtgctcagtaaatacttgttgaatgactttatgaagggaagaaagaaaagatgagtaaggcctggtcttattcaaagctctcctaatcaatatctttgtgattaaacgtggtgggttcagcccctgactgacttcagagcctctgccaggcagtctgcctggatcccaccaggagccaccaggccataagttgactgtagtaatggccaagagtttgatgcttgaggagtccacagtgttggacacccacagagctgaacaagggtgggaccagggaatccagtgaagagggtccttcatgaatcagagggggatgatggaagcttggacctggcaagggaagtgtggggaagtgataggattatgaatattttaatattttaatgcagtagagtcagagatgtcctgatcagataacagatattatttttacagatggttttccatactggaacccaaaggtaaagacactcaaggacagacatttttggcagaggtaagatcttctttggtcaccatacttgagttagccctggggaagtggacatttccatgcagaagcctaaagcttcttccaggccatagtgtctgtcccacaccttctggtatctcttgatatgcagcatagatgaaaatggcaagttccctggctttccttctgctcaactttcatgtctccctcttcttggtccagctgctcactccttgctcaggtagggaatgattccatgattccacatttatgtttctgaagcagacaattatctcaattacctaattaagcagacaattacctaaatgccctcttagaacctttaactcattcccatacctggaagtccatcccaacctgaaggaccacctgtcacaaagagacaaatggtccttctgttaggattgtgttcccctctaggttctctgtatctcgccttccctgtctgagaaggacccttcctctcgtgaccccaactccaaaaccctctgatggagcttcccccttgtgctgacagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcaggtgagcctccaggttttgttctgagaacacttctctgtaggatctagagcagatgcagagtccctcttccaaaagtactgcagacactcctggctgctcactagcaattgtctgcactgcctcccaacttagcttctctgcaacccttaagaaagacacattctttctttagaaagaattcctgctgtaccttacatgccgaagtaaacaactccctccctctgacaaccagagatataagggaaatgaaggacgacggataggaaacattagaaatcatctctttagtgactggtacacagtcattttggtttagtcatgtaacagacggcttctgttgtgtctccaagtgcacgttaccgtgggtcctgggaggtggaatggtgactgtatctgctgccagtgttttccaatcagtgactcccagaaacatttttgtagtataatgaggcatgtttcttacttgttgctttgaggaagaacacacatcatggggagctgtggcgaggtctcagtaaggttttagagcagatttattttacaatttgggcttgtgttaggggatttgggggagggtttatagacttagctctcttctctggatgagatactgtcaggaaggtgtggggagatgaattctgagagtgggagccttaatcaagcttatctaggaggaaggagactagggtgagactaaagctgtaaatgatgaagaggcagcaattcctcattgctgatgggggatgtttggttattgttgtggtttgtacaatgttcatgtttttctctgcactcacaaaagattggggtggtcttgtatttcccatgatctgtcacagtgataaagtactattttttgtgttctgtgaaattacttatgttcaacaggaggataccaagacctggtatcaggttccagacgccgaggagagcttttttctttctcagtgcaatcccttgcctcatggcttctggttgggtttggtttaaggggagctgtagcagacaatggtaggaagaagagaaaagggagaggtctgggtgcttattccctggcttccttcctgcaagattccctcaggctggctgcattgccttgctgaaggtcacaagtcaactcaagaaagtcctcaatgcatcaatctttttatgtctccggaacagatccctctcctcctccctctggtaattggggtggatgggaatagccccacattactgaccctgggatactgcactagcccatttagttttcttttcatcatgaccacacttgtgtaaatagctcctgaatgaaatcttccttggattatcaaatgtgagtctgccattgattcccattgagaccctccctgatacaggagctctcaagaatttagggcaatttatccttctacagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcaggtcagtaccctgcttggcctcagctttactgagctgagctgtggcaggtgatgaagggggatgtgtgagtctctactgtgtgagtctctgcggtcaacctgggtctctacaatgcatgtaaggctcaaagcagggacctgaaggctactcactgctttaggggagcttccccacgccacaaagctgttcatgccacaaacatttactgatcacttcctgtctgacagaaacagaaagtgtgacaggcagtgggaattggggaaaaacattaagagaagctccttatgtaaagtcaaatgacaaaatgggaaaacatatatatatttacaaactcatagagaaagagctaatctttttgaaacagaagagtttgaaaactgagtaaaaaatattaacaaaggtcatgaattgttaattcacaggaaaagaaataacccacaaaagagtgctcattctcactcattagggaaacatatctgaaatcatttttcacttatgatattagcaaaaatcaaaaccccactgccttgcttgataccacatggctatggcaggagtgtaggaaggcagtgactctcagtcatttgctcgtgtcacttgtatttttggtgtgcattagcacaagctctattgggggatctatccaaactacatatttattgatccaaaattccagttctgggatatgcttgcatttgtatgagatgatccatgtaaaaggtttctgggggtttttttgtttgtttgtttgtatgttttttgagagggagtctcactctgttgcccaggatggagtgcaatggcgcaatctcggctcactgcaacctcctcctcctgggttcgagagagcctcctgtctcagcctccccagtagctgggattacaagcatgcaccaccacacctggataatttttatatttttactagagatgtggtttcaccatgttggccaggctggtttcaaactccagaccccaattgatccgcctgtctcagcctcccaaggtgctgggattacaagtgtgagtcaccagcccggcctataaaaagtttcttatagcattgattatgattgtataaggttagaagctatggagatgctcactgatggtgaacttccatacaagggaatactgcccaactgtgaaagaaaaaagagataattctctctacactaatatggaaagatctccaagacacactttacacagaagagtgagatgcagagtgatgtgtatagaatgttatttttagtttaaacaagaggaaaaataggaacatattttaatttactttttttagttcttgattctgttatttaacttacatttttaaaatttaacaagcaattttgtaatactcactgtacatcaagtactttatttacttatttagagacagagtctcactctgtcacctaggctggaatgctgtggcacaatcttggctcactgcaagccccgcttcctgggttgaagcaattctatagcctcagcctcccaagtagttgggattacagggacatgacactatgcccagctaatttttgtaattttagtaaacatgggttttcaccgtgtcggccaagctggtctcgacctcctgacctcaagtgatctgcctgcctcggcctcacaaagtgctgggattacaggcatgacccactgcagcccattaggcccttttaaagtattaatttaattcttctaacctcaggagataggcattatcattaccctcattttatagattaggccactacaaacagagaggttatgtaagtagtccaacatcacactgctagtcacataggggagccagcatttaaacccttgccctctgactccacagtttatgtccctaagcatcatattaagtggactaaggaaaagttaatagatggagggagggagtactaggtagatgggagagttgcataactttatgtacatgaagtttttgaaccatgtaaatgtgttactggttgaaaaaatatttagaaaaaaatgagtatgactctgctgaagttaatttccatacgagaggcagacctctcaagatagtaatagtagtagcttgtagtgagggtttaccaaagtcctctctacagtcctctgagactttagggacagaacgcttatttaacctcatgagatggattccatgcccccaacctgggctgagcagctaaagcttggggtgctgaggctggggaggctgagtgcactagctcccatgacccacagctctccccttcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagaggtatccaacgcaagcagagaatctaagcccctggcttgcatgccccagcctgaagatctcacccccattcccaccctgacactgcatcaagtttaaggtttattttcccaaaaccccccttacccataactgttctttttttcttttctttttttgcttattttccagagaagctccaggaggaactcagtaagttcccattccccaggagacccaggcatgtcttcttatccccactttgagcaccttgataacccttccctattcattccattgcagagtggaggaaaatccagtacatggctcgtgagtgactctgacattttctctgaatttgaatcttgaatctatgactctcttctgcttggaaattttccagcccataagtctttgcccagggttgaaaaatggtcctagatccctttactcaggaaaagaaaataagtttggctctttggagaaaccacccagaaggagtctctctctctcgtctatctctctctctaagaaaagaaaaagaggtcttcaatctctttgtactaggggccacagacctttatgccctaaaaagcactgaggaatatccaggggtacacttcaaaaggaagagagaaggatgaggtgcattttctgtggcaggaaacttacttgttgttttccataatctagaggatgttgaaaggaaaacaagaatggaagatttaagagataagaaaatcagaaaagagagagggagacaagtgtgtctaataaagaggaatagctacagtggctcagttggtacagatttatcataactgctttcaaaaactagtccctgaaattgctcattaaatttcccaaattctttttagagcaaggtaggaaatgatacagattgagaagggtggatcttgtactcctagacatacacatatagacatggtgacacctatgcccaggtacaggagtatagacagattcaaaatagattagctggactccactgggaaggaactctcacagtgactgccctgccactagcattcaaccaatgttcccagacttgatattaagaagaagaggtgaagagagaattgagcttgcagagtgagaccacagggaagagtggaatggtcaaaaagaaagtctagatggatgcgaaaggaagtggaaggggccaacagagcaaaggcagtgttcaggtgacacctctatctttctttcattgtaggtggagagaagtctttggcctatcatggtgagtgagcctgatgctctctgggtttgctgggtcatgtacaatgaacatttcaactttttctctgctgtgacccattgacgttctcagttggattaatcagatctaacccttagactcaattttgcatggtagggggttgacttctgcttttctggagcctctgagagactcctgaccctgcacatgcccaggcaaagcataaccatgcagcctgcaccccccatggcacagggagccgagcctgacattgtttagaaggtgccacctctgatctatcagagctgtagaggaaggaagctgaagcctggaagagactctgaagaaaaggagagaaaacgtgtagtgaaaggagaatggagtggagaaaagaacaaaaatactgacctttttcttatctgtgtctccttcctttcagaatggaaaatggccctcttcaaacctggtgagtaaatcactgtatgttccctggatcaacaacctgagggactatattcctttctcctcctccaactcttgtgatttagggaagaaaagttcccttgactaagaaagtttggggtagacaacattaaatcccaatctgaaaagtgggcccatctccaagacccttcccgctgagagcccagggaaccagggagaattgctctcttgggcttcctcagaccttcctgggaaggaagacacataaagggtggagctgaggggaaggagacacacactgagtgatactgcagggagagtgaggatgcaaatgccaaggagaggaggtgatgcctgcccaaagaactttgcacttcccaggcttctcatgccccctactgcctgtgtcacctcaaatgatttaatgcttccgagctttcgcctccacatttttaaatgaaaattgcaatctgtgttttgtgggggtgaggtgaagactgaagtaataataaatatccactggtcaaaaaccaagtaagaaagagatgacaagttcaaactggttggttgaaaaaggtttgcggaaaggagggataagggtaagcaataaggaaaagtgcagtgcccccatggttcccaacagtggggagctgtcttcactcctagcctgggaggtctaggaaggggaggcagttactggaacccagagaaaagtagctcaaaagagagggctccctgagaagagtcgtcaggccttgttagagtagcatcagctgctgctggcagggaggaagcaggagaataaacagtgtgtctctcctttctttctccttccaatcttctatcagggcctcccattggccaaacccaacagcaaaccagaagacaagggagcccagtggcactatccttagagtacagattcctaggacccagaagagggtggaaaaagctgaaggctggagagtgaatctggggcccctcatagagcccagcatagagacggccttgcagctattagaacatcaggagcttccttcatgccctgctgtgggctgagtaaataacatgattcccctatactacgctagagagtcatatttttatccccatttttcaggtgacaaaatgcttcagatgaggctccaccttgttaaataaattggatgtatggaaaaatagactgcagaaaaggggagctcatttagttcataagcggtcgagtgaagattgaaaattaacctctgagtataaggcattagggggcagagtcaatgtggggagggaaacaagaaaaatgtagcaagaggatccttattgcttcctgaggcagcatcagggtattgggttaggcagatactgaccttactttcatttcccctctggacacaagaccccttgagctttctcccatgacattgatgagagagtcatatttagagcaggctagggacgccaggttctggaaggacctccttagcatggtccaggccttgcatgctgaggctctgaaatccaggaaaaatggctgaccccatggacacctcctcaaactctctgcagcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttactcctcagcttggctttttctagactgtggtgtctactcagcacagtagtctgcacacccactgtactcaccacagtctcagtttacctcactgcagcattttcacaagacccttattggatgcattttctgttgttgccatctgaattaccagaaatgtatagacatttttttttttttgagattggattgtgccactgtactcccaggctggagtacagtggcacgatctcagctcactgcaacctccacctcccaggttgaagtgattctcctgcctcagccttccgagtagctgggactacaggtgcgtgccaccacgcctggctaattttttgtgttttcagtgcagacgaggtttcaccatgttgtccaggatggtctcgatctactgaccttgtgatccacccacctcggcctcccaaagtgctgggattacaggtatgagccaccgcgcctggcttcagaaattcatgaacttaaagcaacacaaatttattatctcactgttctgtaggtgagaagtcagaagtcccacagggatctcaccaggctagaatcaaggtgtctgcaggctggattcctttctggagtctctaaggaagaatctgtttccttgcttattcagactattggcagaatcagttcctttcatttataggactgacgtcccagttgttccctggtttttagctaagggctgtacccacttctagaggctgccacactctggctcctagctcccttcctgtatcttcaaagcagcaacagcgcattgaggctcatctcctaggtctttttctccattgtgtctctctgattcttttaccttctcctttttttccttcctttcttttttttttttttttcttctttgacaaggactcgctctgtcacccaggctgaagtgcagtggcgtgatctcagctcaccacattgtcccctgggctcaagcaatccacccatcttagcttctcaagcagctgggagcacagagccacatcaccatgcctgggtattttcttgtagagacagggtcttgccatgttgcccaggctggtctcaaactcctgagctcaagcaatctgcccaccttggtctcccaaagtgctgggattataggcatgagccaccacgctcagtctgccttttacttttaaagactcctatgattaaactgagatcacccagacaatttagaataatctctctattttaaggtccataaccttaattctgtgtaaaattcattttactgtgttatacattcttttcataactttcatagtgaatatagctcaaagggtgggtgcggggagcactattcagctcaccacactgatttgggaagtgattccaggaaacacaagtgcagaaacaaattgagaaatgaaaaaaagccaattacatgacaaatgggataaagggttcactcatgagtcagttaccatgtggataacttggctgaatcccttttaggactctctaagaaaccatatgaaatgtgtgatatagctcagaatcttcctaaggactacagggcctgggactttatctccacttcccatcctcctttgcttgaattggttgaaggttggcctgggagtgttaattctaatgcactttaagattgggctatgtaactgcagaaaagcaactatcacgggtgtgataaagctcacaggcaaaggagaagggagatactcactggaggtggaaaggttgtcatccttgcagaaaactgtgcctcagctattggcaaactgtgataggccaagagaatatgggatggggcatcaacagcgtctgttataagggctctgcctctgagaatatagtgaatgcctttcaaggtctctctgccctcgctgtaccacatttagcattagtgacctcttctcttccaatacatgcccacatcacatggccctgcagcctcaccacatggactgggtctgggatggacacctgacccaggctaggccagaggaccaagtgacatgtggctagttactcctgtagcagatgtgcatgggagctgtgggaagaaatgctccattcatggtgtggactaaacaatggtggattgcagagaagaccaaagcagatgagcagagagaaggctacaagatggaaagagtttaggcaaatttctcacgtttggttcttttagaagcccagtatcatttcttctttttgaaaaaatgtgttcttttgaggcaagataaatgtactcgttaatattgcttgtagtcctaatattcagaagcttatgcaactattataatatgttcagtgattctgtgagtcaggaatctagaatttgaacagggcagagtaggaatggattttctgtatgtcaacatgtctaggcctcccctgggagtactccatagctggagatgacacagctatattaccttcacagactgtagtttattgtaaagcaaaaggaaatcaatgcttaccctgtatcctggttcttccagggttggcaggtccataaagaaccttgccaacgtgacccttcctgtctctatccctcccactacagagcatgattgggttaggttgttactatctaaccgggcacaccccagtagagcctgatttctttctaagctaccccatcgtcaactgatcctcttccttctcagaacacacacgtttccctctagctcagatcaactttggcagaggctgaagcctggcttagctggatgcttctggcaaaagggctacttcaaagccctgggccttatttcttcaggtaaaaaaatataaagtcagatctcatcctggctggccatgctgttagaccctttcatccttctcttctgcctcttctcaacagctgcccagtcctgtttggaattcatatacatacagttctaatactgatgtatttaccctcataagccactcaacccagaatcttatttgaattataatccagaaacatcaggtgacgtgtgagactactgtatgagaaagagacagtttaagggtcagtccaatggaaaaaagagttctcagagctttctttagcttattctcatcaaagagctttctctgcagaaggaacctactggttcctcctttccagtcctagaaatcctgacctagagtggcttaatcctgctagcacctctctctcgcactctggtgccaaatgactccaggaactgggccatgatgtggtgggaatgaccttaccctgagcatgtcactcatgcattgaacaacagctaagagcagagcttagagcttagagctgggccctgtaaggtgagaggaatcacatcctgcagaagtctgtcctgagaagcaggtactcctgtcacagcagagacacagtggatacctgagtaacaataatacaagacaggacgtgggaacagcaaaagatttgggtgtcagaagaggccgagaacacttcaggcaggaacattcagagttgttcttggaggaagtaggcacgaaggctgggcaggatttcacggggcagagatggagcaagcaattgaaatgaaagccatggcatgggaaaaggagcactggccacagggagtgcaacgttgtgatgcaaggccactgtggagccattgctagcgtattaactgcaaagttttgaattgaatcagaagggaattggaggcctccagactaagcatttagacacttgaggggaatattgacaactgggcctcgggaagattattctggaagatatctttacaattacaagattggagcctttgggagagggatgatgtttacgggaggatggtatgtgtgctagtgtgtgtgtctgtgtgtggctcttggacccaacctgaccacctactatctagaaggtgaaggacaactagaaagttttgctcaattccatcttctgccaccaccagaatgccacctccctgagggaaaaggtttttgatcctcagtcaggattctcagcacctcttatccgatagctttggaatgaatggcaaggccttcataacagccactgcaactgctgtctcctttcctttgctacccctcccgctccagccatgccagcttcccccaagccctcctgcgctccaggcccaacctccaaagccagcaacttgaacaggagtcctctggctttggaaagggggcggcttacgttttcctgctcatgtttcctccccagcaaaattgccctctacatagagaggcctctccttgtggacaccagcaaagccaccgacctcagtgacaaaccccagggaatctccccaaggaatctcaaagcgagagagagagagagagtcttgagagagaaagagagagagagagagtcttgctttcgaacaaagaaaaaggaaataaaaagacccgataatctcaaaaggttatttgctgcttgaaatttgtgattcggtgtattctacccagcaactgctgagaaataaggttcgacaccattggctggttcactcacacccggccaatcctgggctctaaaatacttagggaactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccc

SEQ ID NO: 550 - DNA, 35038 bp, Homo sapiens
cattcttccagtctcgtgtttcatatcctgtgttgtcctcaacaaactccttaaaggggaagaatataggagctgaagccctctaaagtgtttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtctttggagctgagtggaagcctgatgtcccctttccgcataggttctgatccgtttccatatccagaggaatgtgattgtcatccccaagtctgtgacaccagcacgcattgttgagaacattcaggtaagtttccggctggtcggccctggtattcctcagtggagtgggggacaggcagaccttctcactaggcttctcacctcatcgctgcattgtcttttgccccctcccttcccaccaccctatcattttccagcccagggagctagggtcagtagagctgagatgaatgacccatgggctaaggacatcctgggggcagtgcctggtaaagccctatcaggtctgagcacagttgtgcctcacaccactgagaagaccctcagttgcccctgagcagctaggccctgggccacacacaagaacagactgtcctggcctccctgctcacttcccggcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccgtggacagaatgggaaaaactcctgtggccagtttgtgctgtgaatgtgagctccctccctgctagaatggccggcagtctccagccacagctagaatggccttactgatgatgtattggaactcctacctttccaggtctttgactttaaattgagtgatgaggagatggcaaccatactcagcttcaacagaaactggagggcctgtaacgtgttgcagtaagtggcatggagttaactagaagcattgccaggagtttttctaaactaatagagggttagttggaaggattggaaggctgctgggactacttgtgtcttcaaatactattttggggcaattttgaaagttaaaattggggtacctgggaatcactgtgagggacacatctctaattgctgctcattgtctgaacttctggatgtagagctagaatcataacagaaggtgggttgtcaataggcgggaggcagaacattcatttattcattcattcaatcaatatctcacggtcatctatgtgccaggcattttctaggtgcttaggttatcatactgtacaaagttgctgcctccataggcttagggagggagggaagaagagacaacagaaataaatcaactcaaaatatagatgtcagacagcaacaaatgctagacagaaaaataaagtagggcaaagtggataggaagcggtgggtggtagtgggactgatcctttatacagggtgtgtaaagggaggctttgctgtgagggatataccatatgcatatttgggggaagagcattcttggcggtgataacagcaggtgcaaagtccctgaggtgggattgtgtttagaacattcaagcaagaaggccagggaggctggattaaatcatctccaaatgcctcttaaaggaggtggtgctaactttacttaaaatcttagataagtggtgaaaaaaagctttcactctggctgggcaggcattctaaatcatctctttacaagcaatactttctgaataatgtatctaattaaatgtatcaaaaagagttgtctggcatttattactgccagatctgtaattcaatgaggatttgaatctctttcaatgtttctatagccaaaaacgatttttcaccttttaaaaatgatttcggctgggcgtggtggcccacggctgtgatcccagcactttgggaggccaaggtgggctgatcaagaggtcaggagatcaagaccatcctggctaacatggtgaaaccccgtctctaccaaaaattagctgggcgtggtggtgggcacctgtagtcccagctaattaggaggctgaggcaggagaatggtgtgaacccgggaggtagagcttgcagtgagctgagattgcgccactgcactccatcctgggtgacagcgcgagactctgtctcagaaaaaaaaaaaaggtttcagtatctcaagcgctgcttgcatgtcatgatattccatatctatcctgcccaccctaagtatcataggagcctttcctcatcttacaatggcttacttttattggagcttaacaaagtagtagctacttagagcaaaaaggaagggtgaacgtaaagtgggactcaccccccaaactaaactgcttaccttcctatgagcatcatttctggcaatgggtagcaatggaggcaatgggttggtgggctctgcagtaaatccacctggcctcaaatccaactttaacactggtttattagctgtgtgacattgggcaaatttcctagtttttccaagttggtttcttcacttataaagtaggatgataatactaatcgcagctaacatccattgaaccttagcttagaatgtgccagggtcctgcgcccttttccggtggtattatctcatttaatactcagaacaatccccaagctgtcaattctgctgttgtttcctacttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatggaactcagtttctctgtttttgttttttgttctttcctgcagatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaccaacatgtattgagactgtactatgtgccaacacaatttgaagtgttttcctgtgggtgaagtcattgaatcctcagaataatccctttggggtaggtattcttaacatcttattattcacatttgctggaagaggaaatggaggtagaggggagggaggaggaacttgctcaaggccacccaggtagtaagtgactgaaccaagtttcaaagggaggcaggctctggggtagctcacagcgatcgatggtcatcctctttctcctgagccttttcctgccacctttccttcttgcctgtctccactcattccctgtcttgctctcacagcttgccttcaacaccattgtgccaaagagtcaatggcagagcctgcaaactccacaaagatgctagtgttcattgagagaggtgcggcattttcttgggaagtagaggtgtggcatttccttgggaagtagggtggaaaaacaataaagatacttactattgccattaatctggaacatttctgtttgtcctataataattgcttcttatgaaatattccaactatatagaaatgtacagaaaataaactaatgagcatctggccgcccaccttataatgttaacaagtgctggccgagtgtagtggtgcgcacctgtagtcccagctactccgaaggctgaggtgggagggtcgcttgaacctgggaggtggaggttgcagtgagccaagattgcaccactgcacaccagcctgggtgagagagagagactctgtctcaaaacaaaaaacaaagagcgaatgctaacattttgccatattggctccaaacctttaaaaaaaaattaaagaaattaggggttaccaatatagtcgaggaccactttgtgcctctccccatccccattccactgacccccctctccagaggcaaatgcttatcctaaattggtgagtcccctcatcctctgtttggggttggggggtacacctacattcccaagcttccttgctatgttaggaattcctctgggtttgctcagtgagaggtacagttaggagcttgacgggctggagaagggaagaccaggcgtttctctctccctctctccctgtctattgaccttgagcggcatctccagtagaagacacgtttctctgtgggctcaactttttccaggcagcctccaccttgattctatctcctaccagacaaagcttctgggatgaggaagcagcactctttctttgtccttcttccttaggagaagggatctcttcctgctgctgctaaactagttgcctcatctcctttcaatagcccagctcttccatcacgtgtatctgatcacctatcataaccacgtatttgaataaaacatgcaattttcaaaaatcttagcatagtttcttttcttctggctggccctttgactggtatacttcccatccacatttttattatatatgtatttttattatatatgtacacatccatacacaatctcacagactgggtgcttttaaaatgtatataaaatgtatacaactgatgcacaggaagcaatttcaacccagagcccagtgatatctccttagtgagcattttgtgaacattttcttctttgtgtcactgtgattatgacttgcttgataaaaagctttggttataggataaaatgattcggtttctattatgtggttttttgtttgtttgtttcacttgaacttaaccaaacagaggtaaatttaaaaagctaatgtggagaaatgctgtgttttaaaaagcaacttcttacttattctgttttctgtctttgtggagaaggagtcttgctctgttgcccaggctggagtggagtgcagtggcatgatcatagctcactgcaaccttgaattcctgggctcaagtgattctcctgcctcagcctcctgagtagctgggactacaggcacaggcatgatgtcctgctaattattttttgtagagacaggatcttgcgatgttgctatgtttcccaggctggttggaaactcctggcctcaagtgatcctcccgcctctgccttccaaaatgatgggatcacaggcatgcgccacctcaccagccagttatctgattatattttcagcatttatatctcgagtaatgagaaccttacacgtctcagggtcctcaatgtcacaactgtaacaaatacaatgcatccatcctaacatttgttcactattttgtcccaattggttggaaataaagccaccatcatcatcacctaaaccaaagctgcctttatggggagacaatctaaggtatacactacaggtgtgtgttaaaaaactcttatgataatgtagggaacttgcattatgaagagaaaggaaggggagtaaccacagagaggaagatggtaagtaaagtcagtgtggaaaaggaagggagcttgtcgtgggaagtagggaggcaaggagtgaggctcttatgtttcaagtattctctccattcattgtctaagagagggctggaaagatgggtagcagctaccatggagattctggaatcactgtgactgtcctgcctggcccaggtaatccagagggctagacttaccctgttgtatttaagtgagatctggcaaatgctgggcagatgatgccaaactataactgggacctaaagggatttggatgtcccaggcaaaccccctaatgcctgactgtccagggctgctccagtcatttcaacaaccttgcaacagctctgcattttacatgattaaaaatttggacccagcggggcctggtggttcacacctttaatgccaggactttgggaggtcaaggtaggaggatcgcttgaggccaggaatttgagaccagcctgggcaacatagtgagactgttgctatatgaactattaaatataaaaaaatttggaccctacttattgcattattgtgagatttaactgtacattatatttaacaatgtacagatgagagaggcttctgtagaaaatagttttcagtaaaatttgaaagaaccctgaagagtgaagattgttggaaataagttttttttttttgctttaatgaccgtgcatgactatagaaatgtaaactccgaacatataattatgcaaaaataggccagtggcagtggcttacgcctgtaatgccagcactttgggaggctgaggaggatggatcacttgaggtcaggagtttgagaccatcccggccaatatggtgaaacctggtctctaataaaactataaaacttatctaggcatggtggcacacgcctctaatcccactcaggaggctgaggcacgagaattgcttgaacctgggaggcagaggttgcagcgagctgagattgcgccactgcactcctgcctgggtgacagagtgagactccatctcaaaacaaaaacaagcaaagaaacacacaaaaataagagataaacaaacttggacaaaaccatttggcaattttcttataatcaaaagagtttattcatataaataagaaaaatctcagatgccacaaagaaagtttttacataaaattgaccattaaatgacatgaaaaattgtacagactagtaataaaaatgcaaattaaaataagctttatacactatcaaaccagcaaaacttagaaataaaagaaaatctatctagaaagatttgaatattaagagggtttttttctatgttgtttggcaacaagtttatttttgttattcttttacataattttcaaaatttccacaataggaaatgaacttttacattctagagaggcattaaggatttaaaaaataacagatttagctcaattagttattttatacatccactgggaaaaccaaatgaaagagacacttttacttgaaattattctcatttaacaagcctttcgattttagaaaatacgtattctgaatgtacaatgcagtggaatttgattacatttaattttaaattctacctaattcatttgtttttcctcatttgttgtcagcattttcccagacatttcatgaaagttttgcacccttaaaatcttacagtgttgccttccagcacttttgttggttcaaaaatatcagcccccagataagttagggagagttggtgaggaccaagaggaccttgaccgttactaaaaaattacgcaagagaggtacttgtgcctcagggctcttgcccttggtattctcactgcctgggatgctctgccctcagatattagaataattctctgacttgtatttttaatttccttgccgatttatcgtcttttcagagaggactttcttcatcaccctatttaaaattaacctacctcctctgatatttcttcttgcccttctaagtgttttcttcttctccatagcatttgtttatcaatatgtcatgtattttatatatttgctgtttgcttgcttaccctgtttctacccactagcatgtaagctctatgagagaagggatttttgagttctgttaattattgtattccccgcctcaataatatctggtgaataaatagatagatggaatggatggaacaatggatggacgaatggatgggtggagggacggaggcatggatggatggttggaaacatggaaagaaggaaggatggatagaaagacaaatggaaggagggatgggtggaaggatacatggattggggatggatgaatgatggatggatggatggatggatggatggatgaatgatggatggatggatggatggatggatgtgtgggatatgatgaggtttctcttcagataacctgatcaatcttttattctttaattcatagtaatccctccaccttttttcctttttctccttttttctcttttttcctttgttacatgcccaggcatgccacagtaccaggtggtatctgtacctgctcacattcctttccttatttggaaagaggactaactttttagctcattacagacaccccttcccctttattctctgccttttttacgtgcccaccttatctaaaaaaaatccaatgtttagccaaccaggattagtttagattgtacgacctgaccctggccaatggagaaagggtacaggggcagtacttgtgtcaggagtaaaggctctcgtgcccctttttcaggtgtgctctcatggcgactggacaaggaggcacctctctgcgcagaagtaaaattgctttgctaagaatcctttgttcaagtgttcaatttccttaagattttgagcgttattcctaacagttctggagcccaactttggggctcgaatcttctcctttgggaagggggccttcggtcaccccacccggaggggacgcatcctactgtctagttaccgtgcccctaggttgagggagatcagggccccccccccgctttgtgacaaataagtctggatctcagcaaagcggggaggagaagcttgcaagaccgcaacaataagaggaccaggaaattcttgtgcatggaataaggtaggagacttggcgaaggtgacaaagtatttcccaggtggttgggataagctggaggctgacagtgtatgaatgggacttagtatggtggttatgtggagtgagtgagtcttctctatggcctcatgctgccatctgtcaactagagtcaggaacagacagagtagacaaagaggaagggggagggtagaaatccaaacaggttgggttggagcctttccccaaagcctcagtaagcctccaggaagggggagggtagaaatctcacaggaggggttgggcctcctccccataatccctaagatggggaacgtttcaagtaagacaggaaaactaaagagtctagagagtgatgaatttccttctgatagccccttggggcttatgctaaagtattgaaaaaataataagagaaccaagtataaacaaaaacagcagatgatagaatattgttgttttatttaagttcgagaacccatccttaagccctcacttttctggccaaaatttaagtctaatgaagagcgaatttgtcagctgttaatcaaatatgttaacagtaagagccctgtgtcccaggaaaaatcgattacgccctctgctggcggcagggaccagttctcctttaccctttagactctggagggagaaaatcagaaaccaacctttctaaaaaggaaagagttcccatgcctagacaacccatacctaccaagacatgggatcctctaaatcaccttccttccttcagcgcccccaatcctgcccctttggttcccctctcaggtccctccggctgtggtttcaggttactccccagctgtttcaggccacgccccagcctgtgctgtcccttcagctgaggtttcaagttactccccagccgcttcaggccacaacccaccaagttaaaactatattaaatcaaaacgcaaggagggagattaccaactcaaaaattttaaaatatgaggctatctttctgggaaaaaggtgatttaatattaagtactaataattcactttattcagcaggctctttaacgggggatccaaacgtaaaacgagagagcacgcgtgtttaaatcgaattaattaccatacgaaagttcaaccagacttaggaaaaactcccttcaagacagggtggcacttattcatagatggaacctcccaggtgattaaaagaaagagacataataggtattcagtgattaatggaaagactgttaaaaaagtaaaatcaggaagggggtctaataattggtctgtccaagggtgtgaactgtttgcactcagccaagctttaggacatttacaaaaccaagaaaatctatctatactgactctaagtatccctctggggaggcacacacatttgggaaaatttggatggagagggctcttatcaatagtagaggccaagatttagttcatagagaactgatgctcgtgtcctcaacaatctccaattgccagaagagatagctattgtacatgtcccagggcaccaaaacgactcgcctttcacaagtccaggaaataatcttgcagatcaaattgtgataccctatcttgttttatcctgattgactctttcttagctgagagagtcaatagcttgggagactcaattgagagtcaatatcgagagagtcaatagctgagagagtcttagcttggtttcttcgcttgcagccccttgtccccctccttaaggacataactggtgcaagctgactccaagcacatccaagaatgcgcttattgataagatactgaggcaagctgtaccagcagctcctgggagcacacttggttggtggtatccaaagcccctgcttttatcactttgggatactttaagcccctgcacctggaactgtttattttcctgtaactgtttctgtaaccatttatcttttaattttttcctgttctgcttctgtaaaaaattgcttcagctagactccccctcccctctttaggccaaggtataaaaagaactctagcctcttcttccggaccgagagaatttcaagctctagctctttctcagtcgccagcaataaaggactcctgaattagtctcagagtgtggcattctctctatgacttgctcggttacgacatttggaagccccagagagattcgccaccgggtgaagacctgactcattccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaaggtaagtcagatctgactctgtctctctgggagggaaacggccctgacgaaggtcctccctcagactctgtccatgctccaggacactggaggacagagtcctggtttctgtcaggattctctgttaagtctagtctctctctctctctatctcttctccctctctcattcaggtctccgggagatctctgttttagaatgggtataaaaattgtaataaactctgagtgagtgagtgagtgagtgaatgtggagttcaagggcttgcgcttgaatttccagtttgtagctccagggtgaaagctagggaattcgagaaggccctcacctgtggttccgtggtgacctcataaggcttagggcggcatcaggcatagctcgatccaagccaggggtttataccagcctgccaatgccaagaggagcctaagtccccgaaaggggagcagccaggagggcatctgactgatcccatcacgggaccccctccccttgtctgtctataaaaattgccatgcttgtttatataccccagtgcctattgtcctgtttagtgtctgtctaaatttcatatgtcggatcgtcgatactgcccaaaatgactgggcaaggacttcttcaaggtccttagtacagattttctatcccaggaggtcaaattcctcattagtcggttgggctggccatcccagtcctgcctttcctgtcagaaacaaattaggtgttgttatggggaagggtgtggaagacattcacccgtttaggatttctggcaccataaagattgctggcgtttggattgccataccccacgccccaacgactggtccaccttctccttagaccagtggtggatccaaaatagccaccctgctgacctccttactcaccttttctgtcatcccataacttttcccatgcccttaaataaggcactgtgcagagaaacctacacccatactgctctactctgtctggactcttattttacctcttttggctactctccaacctttagggaaatccaagtggcccctttcctcctcatccccatcccttaccctgcacatctcattttcctgtgttgcagcaagtccagcgtctctaagacttggctgtgttctccctccttaaacccgtgaaggaaaggaccgagtttgaacattttgctttcgagtcgtggagacaccaaagttatttgggatataagtcaagaagggggggtcacctaagtcccactggctgaggatcccttggacccacctcttatcctctccatagatctcgaagcttgaggagacagaccttatgtggcaagaaatattggctatagttgttttcctacttcttctagctataatacttctgttcttctgataccatagcctcccaggccgtgaatatctttgtccatgctgggtttaatatttttgttcaaaccttgttaattgcctccagaatagtaaactcttcttcccggccccataaagattggagtcctctccagtgtatgttgcagaatttctctctaggcttctcagatgattacggggtccgccttaaaaaaggcaaactctggacactctgcgaagtagaatggccaaagtttggaactgggtggcccccagacgggtcactacacttcacagctgttcaggctgtgtggtgggtcgttgttggaactcccggtcaccccgatcagtttccctacattgatcaatggctagatttagtccagagctctccttcatggctccactcgtgataaaactctgtagccattcgtgatcctacctccaaggtcctttttagccagacctcacttttgcctccaccctcagctccctcgattcctcctgtactgcctccttctgaagaagaggaaagttttcttcacccatttccaccaccctataaccctcctcctcccccagaatcttcccttgtctcctcaactacatcctctgtggcctctctgcctatatcctcccaattatggcctcagccggaggaggtggccccgctcctcccactgacagaggcccaaatccctttgggcagtgggcgttgtgctccatttttagtttatgtccccttctctacttctgacctgtacaactggaaggctcataatccccccttttctgaaaagccccaggtcttaacctcactgatggagtctgtgctccagactcaccggcccacctgggatgagtgtcagcaactcctttcatcccttttcacctctgaagagagggaccatatctgaagagaagccagaaagtatttccttacatcagccagcttttagagatagcccagagagttttcgacaatcgagaatttgaaaagcaaaaacaggtagctcaggcagctgaaagggctgcagacaaagcatcaaaaagacaggcaaaaagcttagtggctgccatccaagaagccaaaaaggaagggcccccatcacagagcactgaccaggggaccccgagtccccaccaggaaggccagaaacgtgagaggactcccctataaagaaaccaatgtgcttcttgcaagcagattggacactggagaaaggaatgcccattaaagccagaggagaaaccagaaaagaaaaaggtcctcaccctgccccgcagcagaggaatctgatgattgacggggccagggctctttgtcacttggccccgggaacccatggtgaccaccacagtggggggccagcctgtacgcttcctaattgacaccggggtggaacactcagtactccagacacccttaggcagtgtctaataaaaaggttgctgagtaaagggctactggagctattcaggaatatcctgtcacccactcacgagaggtgagtttaggacagaaaagagtaacccacttgttcctcgtggtcccagagtgccccttctccctcctcggatgagacctgcttcataagctacaggcgtccatctccttctcggcccaacaaactcacctcatgttaggggacacaatgccccctactgctcagctcctgctaaccacccttcggtcagaggaatatctcttagtttcaccctcacaactgccggagaataaaagtaatcctctcctactggctttacagactctgtttcctcatacctcccaggactggcaaaccaccatctgccagctgttgtagaactcctggccaccaccctgccggtccaggtcaaacaatatcctatgattctgtgggctatagagggaattaatcctcatattcagcaactattacaagctggtatactcacaccatgtgagatcgcctggaatattccatttttgccggtccagaaacccggaacaaatgattaccagcctgtacaggacttgcaggaaggtaacaagcagacagtcactgtccatccaactgtctctaacccttatactttactcagcctgctcccaccagaacatatggtgtacactgtccttgacttcaaggatgcttttttttgctattcctctggccccaaaagtcaacctatctttgcttttgaacagacatatcctggctcggtagacaccacccaattaacctggacttggttaccccgaagttttaaaaattcccccaccctttttagggaagccctccaacaggatcttttaccattctgagccagtcaccctaactgcactcttctccagtatgtagacgacctgttattggctactgaaactactgacagctgcctgcaacatactacggacctactttacctccttcaggaattcgggtatcaggtcccagccaagaaggcccagctttttcttcccagcatttcctacctagggtatgagacaaatgaaggaaaaagggcactcaccagtgctcgaaaggcagccatccttcaaatccccactcccaccactaagagacaggtacatgaattcctgggcaccgtgggatatggtcgcctatagatattggggttcatggaaattgccaaacccctgtacaccactactggagggaataccccgctggtttggactgacaaagaagaacaggcttttcaaaatctgaagaaggcactaactgaggcccctgctcttgccctcccaaatatctcaaaaccatttcacctttttgttcatgaaaaccaaggagtcgctaaaggggtacttactcagactttagggccatggcaacacccagtggcctatttgtctaagagactggaccctgtggcctctgggtggccaagttgtctgtgagccatagtggcaacagcaagccaggtccaggaggctgataaactgactctgggccagaatttaacccttacggctcctcatgctgtagagaccttgctacaaagtgcttctggcaaatggatgtcgaatgctcgcatcttgcggtatcagagtttactgttagatcagccgcgtttaactttctctcccacaaggtgtttaaatccagctaccttgttccctgatccagaccttaccacacctgtccatgactgccaagaactgttagaaactatggaaactggctgacctcatctccaagatgtgcctctaaaggaggtggatgccaccgtgtttacagatggtagcagcttccttgaacagggagtacagaaggctggtgtggccattactatggagacagatgtactgtaggcccaggcactgccggcaggtaccttggcacagaggactgagttggtaaccctgactcaggccctccaatagggtaaagacaaatgtattaacatctacactgacagcaggtatgcttttgctactgtacatgtacacagagccatctatcaagagcgagggctactcacctcagcaggaaagagtgtcaacaacaaagaagaaattttagccctgcttgaagctgtttggctccctcaacaggtggctgcaattcactgcaaaggacatcaaagagaagacatggccattgctcgtggtaaccaaagagcagactctgcagcttgagaggcagctcagctcctggtcgtgcctttaaccctgctgccctctgtgtcctttccacaactgactgggcagactacccagaatactccccagaggaagaaaaacaagcttcggatcttcaagccagtaaaaatcaggaaggttggtgaattcttcctgattccagaatcttcatgccccaagcccttggggaaacttttatcaatcatctacattctaccacccatttaggaggagtaaaactggcccagcttctaaggagccatttcaagatcccccaccttcaggacttaactaaccaagcagctctccagtaaacggcttgtgcccaagtaaacaccaagcaaggtcctaagcccagcccaggccaccgcctccagggaggcttgccaggaggaaggtgggaaattgactttacagaggtaaaaccacacttggcagggtataaatacctcctggtgctagtagacaccttttctggatggactgaggcatttgccaccaaaaacgaaactgctaccacggtagttaagcttttactcaatgaaatcatccctcaacatggactgcctgttgtaataaggtctgataatggaccagccttcacctcgtccatagctcagtcggtcagcaaggcattaaacattcaatggaaactccattgtgcctatcgaccccagagctctggacaagtagaatgcatgaaccccatcctaaaaagtactcttgcaaaattaatcctagaaaccagtgaaaactaggtaaagctccttcctttagcccttcttagagtaagatgcaccccttaccaggctgggttttcaccttttgaaatcatgtatggaagggctccgcctatcttgcctaagctaaaggatacccatttagcagaaatctcacaagctaacttgttacagtacctgcagtctctccaacgggtacaagacatcatccagctgcttgtcaggggagcacaccccagcccagttcctgaccagactgggccctgccactctttccagctgggtgacctagtgtatgttaaaaagttccagaaaaaaggactgactcctgcctggaaaggacctcatactgtcatcctcaccacaccaacagctctgaaggtggacggcactcctgcttggattcatcattctcgcatcaaaaaggccaacaaagcccagcaaaaaaaatgggtccccaagcctaggccaggccccttaaaactgcgcctaagttgagtaaagctatcgaattaattctttttatttacctcttctgtctgtttccacctgttatgtcctctgccccttcctactcttttctcctcacttccttcatgacaggatgtgtgtttgcaaacaccacttggaaggtgggaccctccaaggaagtctcttttgtagtcggtttatgtgctttgttccccgaccctgcccatacccttgaagagcaatgcaatctgccgatcatgagagcagggaacgctgaccttgctgcagggttcggacacaccagaagccaaactggatgtggaagttctaagggtgcagaaaaaaggctccagagcgttgacttttacctttgtcctggaaatcgccctgactctagttgtcgagattcttaccagtttttctgcccttactgcatgtgtgtaaccttggccacttactctggaggatgaacctgatcctcaaccctttccatagcttgtgcttcccatcctaagccgtgtactataggaaattgtaatcctcttactataactctccgtaaccctagtttaactcaatggtattacagcatgtcatagggattaaggctttatatttcaggatttgatgttggaactatgttcaccatccagaaaaaattcctggtcccatgaagccaatcagaactttaactgatttaggtgaccctatgttccaaaaacacccagagagagtcgatttaactgtcccactgccattcctggttctgagaccccagctgcaatgacaatacctccaacccagcccgatgtccattttggacgggatacatcacctccttaatctcaccaagcctaaactagcctgagattgctggttgtgccgaaaggccaaacccccatattatgttggattaggagtagaagccatgctcaaaatggactctctttcttgtcatacgtgcccccatgcccttacactaggagatgtgtcagggaatgccttctgtctaattagcgcaaggtataacttacctgcttctccctttcaggctacttgtagtgagtctctccttacttccttaaacccctcagtctcctaccaggcacccaaaaatacctggttggcctgcatttcaggcctcactcgctgcatcaatgggactgaacctggacctctcctatgcatgttgattcatgtactcccccagatctacatgtacagtgggccagaaggacaacttctcattgctccccctgaattgcatttcaggtttcaccgagctgccctactccttgtaccccttctagctggccttagcatagctacgtcagcagctattggcacgactgccctgattcaaggagaaactggactaatatcactatctcaacaggtagatgctgatttaagcaatctccaatcagccataaatatactacatgcccaggtagagtctctagctgaagtagttcttcaaaaccgccgaggcttagatctgctatttatctcccaaggaggtttatgcacagctctagaagaaagttgttgtttctatgccaatcagtctggagtcataaaaaatactcttcaaagagttcgagaaaatctagatagatgccagaaggaacaagaaagtaacaccacctttctcattcctggagtaccaaagtaccaaagcatgtttaactggaatccctggctaactactctaattactgggttggcgggacccccttctcctcctcttgttagggttagtcttcaggccttgtatattaaattggtttcttaattttgtaaagcaacgcatagcttctgtcaatcttatgtatcttagaacccaatataacacccttgttataaccgaggaatcaatgatctgattcccccaaacacgagtgggaaatgtgataccctaacttcttttaacctgattgactctctcttagctgagagagctggacagactccattttggtttcttcacttgcagccccttgtccccctcccttaaggacataactggtgcaagctgactccaagcacatccaagaatgcgcttactgataagatactgaggcaagctgtaccagcagctcctgggaacgcactcggttgacggtgcccaaagcctttgcgtttatcactttgtgataatttaagcccctgcacctggaactgtttattttcttattactgtttctgtaaccatttatctttcaacttttttgcctgttctgcttctgtaaaaaattgcttcagctacactcctcctcccctctttagaccaaggtgtaaaaagatgtgtagccccttcttcggggctgagagaattttgagctctagccgtctctcggttgctggcaataaaggatcactgaattagtctcagactgtggcattctctctataactcagtcggttacaataaaatagcaaaacaagttgccatttcttccatttaactccatgccctcctcctactgtaacccgttttctcttccattgaacaaaagacgttgataaaaataggagctaaagaaaatgcggataggaaatggatattatcagatcaaagggaaatgttgtcaaaacctctcatgagggaagtcttgtctcaattacatcaagggacccattggggaccccaagcaatgtgcaatgcagttctccgggtttatgggtgtataagaatttacaccctggccaaacaagttatagatagttgcttaacatgtaaaaaaagctaataagcaggatctaaggaaattgcgccttggtggaagaaatccagcactgagaccatttcaaagtgttcagatcaattacactgaaatgcctccaattggtagttatacttattagtaataatagaccattttacccactgggtagaggcaatcccattctcacgtgcaacctccagtaatgtagttaaagcgctaattgaaaacatcatacccagatttgaactaatagaaaatactgattcagatactgcaacccatttcactgtgcatgtcattaagaagttagcacaggtactagatatacattgggaataccatactccttggcatccatcctccacaggaagagtagagtggatgaatcagactctaataaaccacttaacttagttttagaaactcgattgccatggactaaatatactcctattgcttggttaagaatccggactgccccttggaaagatattggcctgtcacctgaggaaacgctctatggaatgccctacttacactccattgctgacatccctatgtttgaaacaaaggatcatttcctcaaaaattatatacttggtctaggctctaccttcttttcccttgggactaaaggtctcctagcacaggcatcacccctggagtttccagaacatcagcattggccttgagaccatgttctcatccaagggtagaagaaaaggaagctcgaaccagcctgggaaggaccctacctagtgctcctatgtactgagactgcagtctggacaacagaaagaggatggactcatcacacccgagtcaagaaggtgccgccacctccagaatcatgaactgtcactccacagcccacccccaccaaattaactctaaaaagagcttaataatcacttatttattctcttttttcttttcaacagaaggtcatcttgtcatcagtgtaactcaggctagtcattttttaacccttcagtttgatgcctgttcagtcatcccgtatggagatgagcaaggtcaaaagaagctagcccatgttgataagtgtctatgtctataccacaaaaaatcaagcatgtataagtatggagtgttaaaagtcccagtggtgactgggcagatgtttggtggactaataagtacaaagggtggagagccaagctccctgcttcaaataaattatgacgaccaaaacaaaaaactccaactagtccctggtcccaccccaccaaattgtaagccatgacactgtaaccccttgttgctgattataaataatccccggaccatggcccaagagccctctatattcaaacagtatgggctaggaggagatgttgaaggacagatccatttcttagagaaatgaatgtgacaatgaaaaatgacactactcttcgttcatttttctttgacaaaataatttttctgtcaattttgtatgtatttaattttaaccaagtaaagcttcttatggacatatattcatcagatttaaaaaatgagtttcttaaaggtgcaaaaccaggaatagcttggtaaattcatgaagctagaaagtagctaatcaaagttcttattaaaccttctggggttgattaagagtagccaaaattatgccaggtgcagtggctcacgcctgtaatcccagcactttgggaggccaaggcaggcagatcccaaggtcaggagattgagaccatcctggccaccatggtgtaacctcgtctctaacaaaaacacaataattagctgggtgtggtggtgtgcacctgtagtcctagctacttgggaggctgaggcaggagaattgcttgaacccgggaggcagaggttgtagtgagctgagattgggcaactgcactccagcctgggtgacagagcgagactccacctaagaaaaaaaaaaaactattagcgaaaattccttgtaacaaatcccctcaagaggtgaaatctatttccctactccttggccccgtcctggccttgagacttgctttgatcaatagaaggtgacagaagtgacactgcacacattccaagggtaggcctcctacaatgctgctacctatgaacaagcccaagttagcctcatggaaaacggaaaacacataaagagggtccctgtcttccctgacaacccagtccacccagtgaggcccacagaggtgaggaaacccagctgataccacgtggttctgagatcggcttatcagctgattcctgcccaaattgccaacccacaaaatcacgagcaaataaatggttgctgtaataaccagttgggttgttacacgaaaacagctaatagatataccttcttaatctcaattatctaaaaaagatatccctcctcactgattcatagctaagtggttctagaaggaatatttttatgaataatacacatttctttattctgtgcatcacatgaaaatggtcagaatcaaaatggagtcactaatgttaaaaaacaaacaaaagactctgacaaatacagctgggaagaccatgaaaagagggttctaatggttgtacacctgaaaaccaaaagtaccacgaaagacggcgaacaccacaaccttgagcaaaggccattccaactgaacagaaaacatactctgcaaggacctctgaacaactgcctgtccaacctcagactaacaccactttcgtgattgatctttggagccaaggctaattaattcaaagaaattagataatcctcattttttccttaaaaaatttttgttttcctttattttcccaaatatacacatagtttactgtggcatgcatactcccattgcagtggtctattcccagagaaatatttttcttttagggacctctctctgttatttaggtttatagtcacaaaggatttactatttcaacaatactagcactgcatatcatccagtatacactgggaaaataaggtgccccatgtgcagatccaggagactttgtgaccaccagattatgaggcatgcatgtatttatttatttatttttgagatggagtctctatctgtcacccaggctggattccagtggcataatcttggctcactgcaatctccacctcctaggttcaagtgattctcaggcctcccaagcagctgggactacagatacgagccacctatgtggctaattttaggatttttagcagacacagggtttcaccatgttggccaggctagtttcaaacacttgagctcaagtgatccacctgccttggcctcccaaaatgctgggattacaggtgtgagacaccatgcccggaccatgcatgtattattaatgttgaagtagataatttaacaaacatcaatgaagtgttaacatttttcactcataggtgcaaaatatcatgccaattgccttctatgagctgtcgtaagccacagcctagagattcaattccatttcaagattcaaccaaagccaactcatcaacaagaacatgtaaaagacagaaaaacccactaccggcaggctgaaacagatgctgtgacgtggccctggcctgtcatggcatgtcacagcatggcacaggcctatatcatgttccctagactgctgactaccaactagttacagctgactccaatcaggtcgggatttgaccatctctgcactgaacctgcaattgtaacttttaaaattgaaacgctgcttctcacctctcctccctagactccatttcacagggaaaccatcacagggaaagaaagcctttgttttttcttccttctttgctttgctttctctctttcttttacacagggtctcactgtgtcgcccaggctggagtgcagtggcacaatctcggctcactgcaacttccacctcctaggttcaagcaattctcctgtctcagcctcccaagtagctgggattacagacatgtgccactgtgtctggagttgattccttccagtggttttgtggtctggctgacttcaagactggagcagcggaccttcacagtgagtgttacagttcttaaagatggcacagacccaaagagtgagcagcaggaagatttattttgaacagcggaagaacaatgcttccacatcctgtaagggtacctaagcgggttgcctaagcgttgctgctgggggctggggtgaccagctttaattcccttatttgtccctacccacttcctgttgattggtccattttacagagtgctgattggtccattttacagagtgctgattggtctattttacagagtgctgattggtccattttacagagcgctgattggtccattatacggagcactgattggtccattttacagagtgctgattagtccattttacaaacctctagctagccacagagcactgattggtgcattttacaatcctagctacagagtgctgattggtgcatcttacaatcctcttgtaagatagaaaatttctccgagtccccacccaacccagaagtccagctggctacacctctcaccaccacacctacctaatttctgtatttttagtagagagggagtatcaccatgttggccaggcttctttcttaatcttttcttttctttctttccttccttcctttcttccttccttcctttctctttctttctttctttctttctttctttctttctttctttctttctttctttctttccttctttcttccttccttctttccttccttccttgctcccttccttcctttactctctttctgtctttttctgtctgttttctctattccttactcttccctcattccttccctccctcccccaactcttctttccttcctttctctctccctccctactttccaactttgggctgtgttgaatttgttgactcatcgtgaacaaacagaaactccaatgatactgttacccaagagaactttgcaaaaggttgtcatgtttaataattcattcacagaatcctcaatctcacaaaagcctggaatggattttctgtttggacagggcagggaagctactgtggccaggctccagctcttcccactgcagctagcacaagccttctaaagcaggatgtggccaggcacagctcatgcctgtaatcccagcactttggcaggccgaggtgggtggatcacctgaggtcaggagtttgaaaccagtctgtctctactaaaaatacaaaagttagatgggagtgatggtgggtgcctgtaatcgcagctattcaggatgctgaggcaggagaattgcttgaacctgggagacagaggttgcagtgagccaagatcacaccactgcactccagcctgggcatcagagcaagactccgtctcaaaaacaaacaaacaaaaagcagtgagaggtgaagccacctggacttcctgggttgagtggagacttggagaacttttctctttagctagcagattgtaaagtcaccaatcagtgctctgtgtctggctaaaggattgttaatgcaccaatcagcactctgtaaaaatgtaccaatctttcatcccatctcatcccatctttcagtcacttcacaaatggttcctagtagatacaaaacagttttttctccaatgggaaaacagaaaacagccactcagtttgctcccaacacccgtttctagccgcttaccacagctaccttggcaagtactctaggagtatgggaaaatgaaaacgacaaactcacacacctttttaacatacacaaccagttctgactacctagccaaggcagattcttcttctgtggaatgtcaacctatatctgcctcccgaccaactggacaggcacctgcaaccttagtcttcctatgtcccaacattaacattgccccaggaaatcagaccctatcagtgcccctcaaaactcaagtccgtcagcacagagccatacagctaatacccctgcttatagggttaggaatggctactgctatgggaaccggaatagccagtttatctacttcattatcctactatcacacactctcaaaggatttctcagacagtttgcaagaaataacaaaatctatccttactctacagttctaaatagactctttgacagcagtgactctccaaaaccactgaggcctaggcctcctcactgctgagaaaggagggctctgcatctttttaggggaagagtattgtttttacactaaccagtcagggataatacgagatgctgcccggcgtttacaggaaaaggcttctgaaatcaggcaatgcctttctaattcttacaccaacctctggagttgggcgacatggcttctcccctttctaggtcccatgaaagccatcttgctattactcacctttgggccctgtatttttaacctccttgtcaaatttgtttcctctaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcagtaagtggctagagaggtcatcacccaattcccaacagcagttgtggtgtcctgtttagatgggggattgagaggtgaagccagctggacttcctgggtcaagtggggacttggagaacttttctgtctagctagaggattgtaaatgcaccaatcagtgctctgtgtctagctaaaggattgtaaatgcaccaatcagcactctgtaaaaacgcagcaatcagcactctgtaactagctaaagggttgtaaatgcaccaatcagcactctgtaaaatggaacaatctgcaggatgtgggcaaataatggaataaaagctggccaccccagtcagcagcagcagggaaccgctcagatacccttccacaccgtggaaactttgttcttaccctcttgacgaaaaatcttgctgctgctcactctttgggtccacaccacctttaagagctacaacgatcaccacgacagtctgcggcttcattcttgaagtcagcgacaccacaaacccaccagaagggagaaactccagacacatctgaaggaacaaactccagacacaacatctttaacagctgtaacacacactgtgaaggtccacggcttcattcttgaagccagcgagaccacgaaccctctggaaggaaccaactctggacacagcaggacgtgagacttctacctgctcactcagaatcatttccgcaccaaccatggccacgtttgtggagctcagtacaaaagccaagatgcccattgtgggcctgggcacttggagggtaaatatgcaaatctttgcacaactttcttctctggagggctgtttgggtgttttctctttctacattcagccagaaaagcctggaggtcgggtaggggtttggagaggtgaatttcagtcctggagctgggactcgggttgctttcttttctcaaagctgattcaagctgcaatgctgcaagactggctttcccagcagtgatgagaactcctctagcaagtatcaaatttcaagcagagttggacttaaaattgttttccagggcagtttctctctctggctctaggacacttaattgggcacaaggtttccccagagtcttggctgtgggtttgttgtgggctgggtggttgtggagaggatgcagagccagaagtccctggcaccactttgcagatcaccatgtgggacttgggctagcagcatccctatgacctgggagcttgttagacatgcagaactggctgggtgtggtggctcatgcctgtaatcccagcactttgggagatccagacgagaggactgcttaagcccaggagttggagaccagactgggcaacatagcaagacccaatttctacaaataatcaataaattagctgtgcatggtggcatgcagctgtagtcccagccacttgggaggctgaggtggagattgagtgttgagcctgagaggtcaaggctgcagtgagcagtgattgtgccactgcactccagtctgggcaacagagtgagatcccgtgtaagagaaagaaagaaagagaaaaaatgcagagtctcaggcttcacccaggctacctaacgggcatctgcactttaacaagttccctaggtggttcctgtacacattgaaatctgcaacatgctgggactgcagagagcctgggctgggagtcgtgagctccacccggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggctctctttccttctgtgcacactgacttttttccctctcctgtgccgagctggagggtaggaccctctgctgcagcactgggtcattctcaggataaagtcttggtctatctgggcgaacagatcacttccagctcgattcatacatactgactcttgcttgaatagcaagatttgccccaaatcagagctttaatcctatataaatggaacaaataatcacttccagatctccagggaatctgctcacccttcataagtttactagacagtttcagaattttggaattgaatgtaagaattatgaagggagctgccttcaacacgtggggatgatagattaaaggattatgaacttagcagtggaggtgaagaagggtgtagtatagcggttggggtcacagggctgcttctagatgccaggtggcagcccgtttcttgcccaggtggtagggtagttgtgcatctctgttttgtgtacttttcaatgtttgttacctcacaatagaagaggtttaaaagactattttgtgagagatcaagttttaagtgctttttgcccccatcattggcttggctaggttagaacaaagtgtgataattgtatttcctttttttcttttctttccttcccttctttctctccctctctctcgttctccctacctcgctctttctttttataggaatggaaaacaaactctattcctataagcttctctatttctcctttttttccaaaatgatcattgtataatggacggcctgtactgagcctgtgtgtcaggtaatgtggttaacttaacattcattacagcatgtcatcaccacaaaggcctcttgtggctggtgctatttttttttccattttgccgacaaggtttagagagattgaatcacctgcttagacccacacacccagtaagtgttggaatctggattgatgctgtaatgaccattatccagatccttatcaccgtttggggaaattgtctgaaaatccctctgggttatttagagtcaagctttcatctgggtcttcagaaagttgtagtggagccatctgcaccaccacacacctgaagacatttcaggactaacctggatgaaaagggaactgacttttagctaggataggacaaaagggcataatcataaaattaattcactttccttcctttcttttgaaaacttttctaaactgtgtatcctcccagatattccctggcaaagaagaccccagcgaagccttggtttggagaaactggaccgtgtggggcaggtgaaggtggtctggggataagagaatatggtggttgctgagtgtggtgtaattccagctactcaggagttgggaggattgtttgaacctgggagtgtgaggccagcctgggcaacatggcaaggtctcatctcttaaaaaaaaaatacatgtgtgatgggcttttcttttgcttttcagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgcacatggcgcatttggtgggaggccttcacttcaaggcaggcagaagtatctggatcgggtgggcagcaagaactctgtcggccttttctacgtgtacccgttttcatctctgccttgataacatccgtggatacaatactatccatactccaagccgttattgatatttgaacatgtcgtggctgccccacctgcctgcgggttggatttcccatagtgggcttggctccctctgggcctccctgttccccatcagagggatctaccatctgcccagaggcagtcacaggccaagggtgcaggcagggcttgatatgaagcctccctctcagcactgtggtctcagcgactgtgcccctgaggttctcagccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaa

SEQ ID NO: 551 - DNA, 35269 bp, Homo sapiens
gatttcacaaggaaactttggaaaaggtaaagaaagaagagagaaagtaaactaggccctggggccttcctccaggcaaagaggcaaccaggcacttggcaggaaatacccctggacggagatgagacctgcagccccagggaatggaaggaggaaagagaatctggtgagtaggtgggatgcagccaacgtcaaatagtcatttttccacgtatccagatgagggagatggcgtcaattactctaagtcatgagatcggaagggcacaggataattggctggaaaaatgctcctttgggtgcatatttctgtaacaaagaaaaacacatttatgagcatttgttttgtttgtttgaggcagggtctcactcagtcacccaggctggagtgcagtggcacgatcatggctcacagcagcctcaaactcctgggctcaagcaatcctcctgcctcagccttcccagtagctggggctacaggtgcacaccaccatgcctggctaagttttgtatttttggtaaagacaaggtctcactatcttgaccaggctggttttgaattcctgggctaaaaggattctcccacctcagcctctcaaagtgcttggattacacgtgtgagccaccatgcctagccatgagcatttcactgaagatagaaggaagagaaatcctacgaagtgtttttcagggaagggatgaaaatggaaaatcctagcaaatgctcattactactcatgtaaatgtgtgcaaaatgccactggaattttctttccttttttccgttgtgaaatatttcaaacatatagaaaaagacaaggagtaatataacaaaagccttgtacctaccaccagaaatagcaagtgctaccattttgccacatttatgtcagatcattttttaaaagaaatgagacagcccaggcacagtggctcatgcctgtaatcctagcaccttgggaggccgaggtgggaggattgcttgagcctaggagtttaagaccaacctgggcagcatagcaagaccccatctctacaaaaaacaaaaaattaatggggtatggttgttcgtgcctgtttcagctactcaggaggctgaagtggaaggactgcttgagactgggaagttgaggctgcagtgagccatgatcacgctgctacactccagcctaggcaacaaagtgagaccctgtcaaaaaaaaaaaggaaaagaggaaagaagaaatagagaaagagagaagaaaggagaaagaaagaaagaaagtaagaaagaaagaaaaaaggaagaaaaagaggaagaaaggaagaaaaaaagaaaaaaggaagaaaaagaagaagaaaggaagaaaaaaagaaagaaagaaagaaaaaagaaagaaggaaggaaggaagagagagagagaaagaaagaaaaaaccttacagacacagttgaagtctttgtgccccttttccttcctccaactgtcctgaagttggtaggtattctcacactggtgctcatactttaccatatatgtattactcgtaaattacacctagcattgctttgagtgcttcttaatttatgtaagtgatgtcacactaaacccaccattctggaacctacttttttttcagctaaattgtgtttccaagatcggtccatgttgatgcatgatacattcatttttactgctgaataacatgaaactgtacaaagataccacaatccatccactcacctactaatagacatttgtttccagtttttcaccatcacaaatgattctgcagtggacatccttgaacatgcttctgtagagtagacccctacaagtggtgttgctgggccgcagggaagatgcgttccagttattagacatgctgtcaatttactcgctagcttggctgagccagttcacgcttgtgccagcagcagacaaaacaactgaaaatgttatttattcagtgtgctcttggattgggctctcttctgaatgcaaaaccaattataaggattttctctagttcgttcccgacctttgttctccaattctactttcccttaaagtcttaaattctttagccataaattcttctacaactagggttttccagaatctgacctagtggccaagaagaaatgactggtatgtgtgttacaggatggagtcgggtatgtgtgtgtatgtgtgtgtgtgtctgtgtttgtagctttgtaccaaagccaacaagaaagaactggaaggacaagactttccatagcatcttttaaatgatgcatcaaacccaggaaagaggggtaaccagtgtgacccagaatccactctcaagctataggtcctttcctccccctcttatttgttgggggtcaagggggagttgtcccaggacattactctgtggctccatcttccctgctccccaaacccaccagactccagacacttctctaagctgtgtaaacctaggggtgagggaaagaggtactctgtgcagaggaggggcagccccatgtgttcatctggggtaaagggctgacttttggccccaggcctaagagctctctgtccatgccaaagattcctcctgcatctgggcctgtggggttgggagagctgccaaaatcctagactgggcagtgacagtggagagcctatatcttggccactgagccgattcctcagccccaggaccatacagaagttgtctggaattccttccctcacaggccctgaagcaggagcctccaaggcctctgaagttgacttgagaaaaggggatggggggataaggagggggatagggattcaagggaccaccacaaagttgcctagctcaaaccaaagacatttcaagaggcaggaacctgaagtgaatgaaaaagcacaattcacagttaagcgagagtagggagggccctgacccaaagactatttttgtgttttttgtttgttttttagggtttttttgagatagggtctcactctgtcacccaggctggagtgcagtggtgcaatcacagctcactgcagcctccacttccgaggctcaagcaatcctcctgcctcagcctccccatagcagggaccacaggcacacaccaccacacccggctaatttttaaatttttttgtagagaagggatcttgctatgttgcccaggctggttcaaactcctgggctcaagcaatcctcctgccttggcctcccaaagtgctgggattacaggagtgagccactactcctttctttctttccaacagaaagactatttttggatgggatttctcccccagcaaacacttgaagtgtgacctacaggagttgtttgtttggaggggggcatttgtcctttatcaaaaagatgaaacctggttgggtgtgagtttcttgcctgtaatcccagcactctgggaggctgaggcaggaggactgcttgaggccaggagtttaagaccagcctgggcaacatagggagaccctgtatcaacaacaacaaaaaattaaaaattagccaagcatggtggtgcacacctgtagtcccagctactcaggaggctgaagtgggaggatctcttgagcccaggagaacgaggctgcagtgagccatgatcacaccactgcacttcagcctgggcaagagagtgagaccgtatcccaaaaaggaaaacgataaagcatgaacatcttggcgtccttgttccacagactccttttggcccagaacagtctgccctttgggcagcaggtggcttgcttcagcctggaggccaggaggcctactcaggcgcccagggcgattcaccaagggacctcacctctgagccccgcctaccacccaatgaggacgcgcggacatgacgtcactgcatcctgttgcccagcccagaccaggagaatgggacaagctggagaaaagagccagtggaagtgccagatgccaagagagaagttgggggaaaaaatggtggagggcaaatgagtcagcagcaagtttaagcaatgaaccattgcatcacggggtgtttctcaaattcttgtctacttttagaaaaagtacgcaatgacattcagtgggcatcttgattctgaaatagctaaagaaaatgttaaaaatgcagtgggtgaagatgtgcccacattaacctcttttctaaaacaacagttgacaattgtgctacatgtccttaagcaaatcttttagcctgcctgttccttagtttcctcatctgtgacatgaggggaatgtatgaaaaatatctctggagattccttccagtctaacattctgtggtttgatgattgatactatgctcacattcttaatactcaggctgtgtctacacagtgccaagacaactagctaattcagtgagtatggacaaaatgttcttccaatcaattctttggcacgctgtagacaaattggcacttcttttcattttacaactggttgctccggcttcttcttgaccagtgcttcttcaatggtggtatcctgacatgctgtatgcctggagcacttaggaggtgtgtcctaggcagttggctatggataatgaactgttgaggttctcaaatcgttgatgacttttttttaatcaattagaacagattcaatatggtcctatagtaatgcccctgctgcttagttgcaatccgatatgcctccctgaaaggaagaagtggtggaattacagctgccggacagagactgcctgtagccctgaccctgttggatgcccatgggagggtgtcatgtgttgtgcatgtgaatgtcatttatcatctgcaacacagcacttgagaatgactgatggaaacccctgagacatggtcggacatcaaggcactggagactcaggccctggagaaatctgagccagcatcctatgacgcaggtgcaaaccaggaagagtacagaatggagggcctgttcattatgcctgtctcttggtccaaaatgaatgatttcaccataatctgttcatagctggggaaggaaagggggcgtgaaatagcgtttattaatcatgtaggggccaagcccagtgccagacactcgtggcaggttttagtgttgctcgccatgtactttttattctcagctgtccagggggattacacttcctccctcttgtggtttggaagagtaatgtaaaattctggccaatgggttgtgggtagaagtgacatgtaccaactgaatgccagggcatttcgctgatagttttagaccctccagagctccctctccctctagcatgggaactggcaacagtctggtggctcttccatcaccagctggaatcctggaatactaggaaaccgagctccgagaagagacatgaggcgtgtgtatcatgcattgcacgtgaggatggagtaaaactttgttgttgtaagccaccaagattttcaggctgcctataactgcagcacaacctaattttgtgctgtctgatgccatgttttatataacatggtagtgtagtagaaaaatgtgagccttagagtttaaaatgctgggcacgatgtctcacgcctgtaatcccagaattttgggaggccaaggtgggaggatggtttgagcctgggagttcgagaccagcctgggcaacatagtgagactccattttattttactttttaaaaaaataaaataacaatttaaaaaatagagattaaaagacatgagctaaaacctaaacactcactgactgtgagcaaatctgttagcttctttgagtctcagtttcttcatctataaaatggcacgatgtttttattaggttcggaaataatatttaaaaatatctagcacaggatttggcacatagtagatgctcagttacaatgattataatttcatgtattcctcaaaataatactatgagtaaagagagggtatgggtgtaagagaaaggatagtcattactgatgtttcaaatgccgtcatacactatggagaacactgaccagggaccccaagggtaggggaaggtttgaagtcatctgtgtccaccctcccctgaactcagagaagtcctagaagggagagaaggcctgaagacaccatttacaatttagcctttccactgccagaggaaaagcagattctacttatggtagtgactattgacaccttcagcatataaaataagaatatagcagtggagtgagttagtgtccctgttagtttcactgaagcttgttatcctagcaaagcgccagccaaggtctttcccaaaggcgcaatgaactaaactcttctctgaaatcagcttattagtattatcatgaccacttcagctagctcacccaggacctgggaatgagctggagagtgaactacagaggaagggagagaaagagaatatcctcaaggcagcaggggattgaggggtcctttgtctcctcctgcttcccagcaagtcttgcctgatggaggaacaagagcagtcagaggacggggtggggaaattccaattctgtgtgtccttccttcaccatgccagctgctctggaaacctccagttccaggtcagatgcctgctgcagttcccacttatatttaatttggtagagtatatctcctccaatcccagttttctccaaggtctgctcccagatcatcgtttgcctcttaaataccacatcctagccatgaacttggaattctgaacattcaatggcctgcccccttggaacgcctcaattctgcctctgggatgaaagttccttgcacgttttcacacacatggagtgcagagagtcactgaggacccaaggagaacttgaacatcaccttgaccacctgtcatcagcaggaagtcaggctggaagcacttgttgaagcccccacaacctttggtgaatgaaaaatagagatgttccattccagacaaagcactgcatgcttgggcagctgttccacctgccaccaatccaacccggatttgctcttcactgacttttcacttttccacgcagaccaagaccccatgaaaatgcccatggccagtggggtgactgatttccagcaaatgtgtggtccttctaaattggggaggtttaccagaagcatgtattagatgaacatggatttgtgacctgtgctcaggtccctgttagtttcactgaagcttgttatcctaggaaagcaccagccgaggtctttcccaaaggtgcaatgaactaaactcttctctgaaatcagcttattagtattatcatgaccacttcagctagctcacccgggacctgggaatgagctggagagtgaactacagaggaagggagagaaagagaatatcctcgaggcagcaggggattgaggggtcctttgtctcctcctgcttcccagcacagctttaaaccctgtgctcagggtttaaagcatggcgagaatggaaaccggatggtgagattgagtcctggtggggctagttgacttcattttgatcaagatcacagattttacccctgacccagattaaaatctataaaatgggcttttgtgaccatgagagacacaagcagtgacgtgcaggagcagacttatagtggcttgtgagagccaggtgtaaaatattctggagctttgtaagccaatttttaaaatcattagtagcttgaaatctatcgtggtgcaagtatttataccatggaaattggtaaacccctacaaatcggggtttctcttcctccttccctcctcctccttctttgtgagagctagtttaccaaggcatgtgtgtcttctcgcaaaaccattctttcattggaaaaactattccagatatgggatcaggggaacagttttgtatatgggaagaacatagctctctggaatcacagacagctttgaggactcaaaaaaaaaaatcaacaaccaacttttaacattgatagaaactttgattagatagggagttgtggcttcagtgactgtgctgagattttaaatttaaaagatcttgctgaagtgaaaattacatgtaaatgttgggttgtatagcactgtaggagtctgtaaaaagagctgtagtaatgttctgtaaaaagtctttattgaattctcagtagagcagtggtctgtcgttgatgtggcttccagggagggagcatctggcccccaatccttgcagagaggggctgacacccggattgctgctgactgtgcccactgctgtgggggctgctgcaggagggaaaaagagctttgaataatctgttacgagctcaaccgtgtcccctaaaattcatacattgaattcctaatcaccaatgtaactgtgtttggagataggatctttaaggaggtgattaaggttaaatgaggtggggcaccaatccaatctgactgatgtccctatcaaagaggaaatgtggacacacagagacacactggggatgagcatgcatagagaaaaggccacatgaggacacaatgagaaggttatgtctgcaagccaaagagagaggcctcaccagaaactaagtctgtgggcaccttgatcttggattctcagccccaaaactgtgaggatgtaaatttctgttgtttaagccagctcatctgtggtattctgctatggccgtcctagctggctaataccatctgcaatccagattgcttatttctgttcttatctgttgattgatcagttttacagggtaattgaccttcctccacaattcttcaggctctcctaaccctgcctgagattctcaatgtgcctagtcacccaactgtgacaccaaggggtggggccatggagactgactcagaacttggcaggttaccttagggggtgacagtcagattgaacgtgtgtagaacttagctctgccagcatttagctgcagaatcatgagcaagcctttgtcccctttatgcctcagcgtcctcatctgtaaaatggaggcaaaaatattctcccttataagattatgttgatgataaaacaagatcatggaaggataagcacgtggcacagtgctcagtgagcactctcttctgaagcgaagcaggcctggggacagcctggcttagagatggctctgcttgccctagcactgggtgggtggaggaggcatcgggggatggggagggtgcctgagagggcagggtcattcctctccaggtgacctgcactgtggggagcaggtcacctcactaggacagttcctcctgggaccaagaccttccccctgttgaatttttctccctttggttgttccctcacagaacatgctcttcatggagaatactgtgtggcttaaataagataatcaagtaaaagcttcacagagagcctggctttcagcaggcactcaatacatggtaacgatttctacatctgcagttcctaaagcagctttcacgccaccccccagggcagctgtagccacagaattgaggcataatttggacactgttggtagaaacagcattgggtaactttattaaccaatttggttcagccttattaaggaggagagctccattcatgccaaaggcttctccaagcccttcgcaaataaccaggattcaacagcctgaactcccccaagaatgactccgtgccagaacacagcacaacccagcagtgtggcccttcctgattctcccatcctccttgccacatgggctgatggaggcttaggttctgtggctttaccgagctccaactctcttcctgcacttgagcaagagcacttggtgacctggtgagatggtagaaatggacacaagccctgactcctggcaggagacttcagacttgcagcatgtgcttaaaccacaggaaacggtgtggctcacaagtggtctgagcccaggaatgatgaaccccatgatgctgggagttcatctcatcgagtcagctctgtgacatttgggccatggagctgtggacccagctctccaggaacttctgcctgcagtgactgaaagctcttttgacacttttctattttactatcccctgggatcctgctgagcacacagggaggcttcagtagaagtcactttgtgtctctgtgtcaccttctgattaaaataactttaaaagtcatgttctgggccatgcacggtggctcatgcctgtaatcccagcactttgggagattgaggtgggtggatcacctggggtcagttcaagaccagcctggccaacatgacaaaaccctgtctctactaaaaacaccaaaaaaaaattagtcagtcatggtgcgtgcacctgtaatcccagctactcaggaggctgaggcacgagaaccacttgaactctgggagtagaggttgtaatgagccgagatcgtgccactgcactccagccagggtgacagagcaagaccctatcaaaaaaaaaaaaaaaggaatcaaaaagaaaaaaaagtcatgttctggaatggcctgcttcgtaggtacaaaagagcagggtttgcagagtcaggcaaaataaagggttggcttgcaatctaaccttatcagagacctggtggctaagggacccttctgtggagatttgcgagaatgtactcagcagagaggtgaggctcagaaatgaattcaggtaaggaaaatcctctgctgattcagaaaaagggcactcacgagtttctaacattctggaaacatcacatgttactctatttactccctatttactctctttctatctgcagggcccaaagcaggatggagataaagatgcccagaagaaaccaaagccttcttgggggaaactgtaagaagtcaggagggaattctttattagaaattgaagatcccgctgggcgtggtggctcatgcctgtaatcccagcactttgggaggccgaggtggacagatcacctgaggtagaagttcgagaccagcctggccaacatagcaaaaccccatctctactaaaaatacaaaaattagccgggcgtgatggcacgcacctgtaatcccagctactcaggaagctaaggcaggagaatcacttgaacttgggaggtggaggttgtagtgagccaagatggcgccattgcactccagcctaggcaacaagagcgagactccatctcaaaaaaaaaaaagaaaaagaaaagaaaagaaaaaaaaagaaagaaagaagttgaagatcaaagctggagaccaggactcttgacaaatctgaccagatttgaaacacacctaagaaatgtaagactcaattaattctacatgagcctaagaattaaaccaaataaagaatgacaacacaagtaatgaggatactggcttatgcctaggtgtttgtatttctttaggtctaactccaactgtatatcctattttaaattaatatttgttattctttgttttttgttattttaataaaaagctctatttaaatgtatttaaataacattagccagatgtggtggctcatgcctgtaatcccagcactttgggaggctgaggcaggtggattgcttgagctcaggagtttgaggacagcctggccaacatgatggaaccacgtctctacaaaaatacaaaaattagccaggcatggtggcacacacctgtagtctcagctacttgggaggctgaggtgggaagactgcttgagcctgggaggttcaggctaccatgagccttgatcacaccactgctctcaagccaaggcaacagagtgagaccccatctcaaaacaaaacaaaaagagaacactaatgccgttagaaaagaatgctttcattactaacaccactggggagccaagcaattcaaacccgcctgactccatgtggcagcttatttcaagtacaggcaaggagactcaaaggaaataaacagtgtgtgggggttctagcgatgcaaacctataaggttcttgtaactatcataatgcttgatcaatacttattaacaaaccacattctaggaggaacaagttttaaaagcctgaaaattggacagccaacgtcctaaaggtgagtgagtagcagtgagagagagaccaaacacagtgtgtccctggggtgatgctgctgtgctttaggtgaaaatgtcagtaaatggtttagccttcacatacaaaaaagcacaccaaattctacagtagtgaaaggtggaggcattctgtgcaaagtcaagttagactccttggaggttccaagagctcagaggagacccttgggttttggagatatcctggggcaacttgtttggttaaaaaatgtagaaaaggaaacactggggacccacaaagagatgaaaaactactcttttgtggaaactttcatttctcatcaaatatccatgtacccacccacttttctgaccctcttccattagttaggggccttgtggctgatagaaaagtgactgatgctgcttctgggctgatgcatgtaggagctggcacccaacatgccaactcgggccacatgctgaggtgtcagggcgggatgtggaatagagctcctcctccaagctgacttgggcgcattgtgtaagcacgcaagaagcctgggaggtgcaaggcctctgagatttcagaggtagtttgctcctgcagtttagcctcatttgatctggtgtgtacatacttcattcctatgccaatctcagtaaccaggccaggaggtaatagaacctctgccattaacccatgtgtgagcttgaggaagtcactcttctctgggtgtcattttcctcatgtggaaatttagagttgggtcagttggcctttctgctctgtcagtctccaattttgtatttttgaaaatttccatctaatagtgtctgaaaagttgccagtactagtgtctgtctatccctgtctattatctacatagacaccgccccatccacccatctgtctatgttcatccatccatcttcccagaatccatccatccttccatccatccatcctcccatcatccatccttccatcatccatcctcccatccatccatccttccatcatccatcctcccatccatccatcctcccatccattcatcctctcattcattcatcctcctcttcatccatcttcccacccatctccatcctcccatccatccaccctcccattcattcttcctcccatccatctccatcctcccatccacccatccatcctcccatccatccatccttccatcctcctattgtccatccttccatcctcctattgtccatccttccatccttccatcctcccattcatccatccatccttccatccacccatcctcccatccattcattctttcatccatccatcttcccatccatccatccttccatccatccatcctttcatccatccatcctttcatccatccatcctcccacccattcatcctaccattcatccatcctcctattcatccatcctcccatccatctccatccttccatccatctccatcctcctatccatccatccttctatccatccatccttccatccatccacccatccccccatccatccatccatccgttcatcctctcatccacccatcctcctatccatccatcctcccatccacttatctgcccatccatctccatcttcccatccacccattgctccattttactcctgtttcattatgaagggagctgggacagctgaaatagtgtttgggactcaacaatttgcctccccttccctacatcccttactgtgatggttaattttatatcaaactggctgggccacagtaccagatagctggccaaacactattctgggtgtttctgtgagggtgttttggatgagattaacatttaagccggtgggctttgagtaaagcagattaccctccaccatgtgggtgggctccatccaattagctgaaggcctgatgacaactggcaacagcaaaacatcctcagagatacacacatgagcagaaatgcaggagcatgctctgaattccctaacataaacatagaagggcacacaccccacatgcttacaaacgaaaaattcaaggtgctgctcagaatgtgctaacacaaagcaaatgctgtcacagtacctcagcactatccctcccgcccgcactcctgctctgcccagggtcatccagtgcctcttggccagtcagcatcccctgcaccaactctgccacccccatggccccttcctgatggtgcttctgattggttgcaacatggacactcagagtttgggaagaggaagcagtgattgtgctgtgctttgcaacccctccgcctgcccccactccccaattctctctctttctctcttttttttttttttcagagaacttagcagtaaaggctaatttatgaagtccctaaagatttgaactttctgcagaactggctgcagtttccagtgggttagagtctacttggagtagagcagaagctgtgagctgtgctgccgagaggagggaaggaagaagccacagcccaggacccacacccgtccagcatccccaacagccttcctcccctacagagagctcaaagatgacaccgactgttaggtgtgggataagagggacacagggtgtgggatgagatccagaagagcaggaagggggaggggtcaggagctctgtggttggagggaccacctccgttactaacatcccagtcaaattcagaaactatccaagccctggaggctcctaaaggcgcttgctccacccttgtaccatcccagttccctcctaagtttgcaagatcaaatccagtttaaggctactccttcgattttctcatgtcatgagctgacacccactgctgggaccaaatattcatttccctccccatgaaagccaaagctctattcggtaaggataaattcacattaaaaataagaggtttacagtcaggtgtggtagctcacgcctgtaatcccagcactttgggtggccaaaacaggaggatctcttgagctcaggagttcgagaccagcctggtcaacatagtgagactccatctctacaaaaaatttaaaaattagctgagcatggtggcaagtgcctgtagtcccagctagctgggaggccgaagtaggaggatcacttgagcccaggaggtcaagtctgcagtgagccaagatcgcgccattgcacttcagcctgggcaacggaacaagatcctgtctctaaaacaaacaaagaaactagaggcttttttttaaattattttttaatttttttttttttttttttttttttttggagatggagtctcgctctgtcacccaggctgcagtgcagtggtatgatctcagttcactgcaacctctgcctcctcagttcaagcgattctcctgcttcaggctcctgtgtagctggcaagcaccaccacacccggctaatttttgtattttttagtagagatggagtttcaccatattgaccaggctggtcttgaactcctgacctcaagagatccacccttctcggcctcccaaagtgctgggattataggcgtgagccactgcacccagccatcgaagtagaggcttaattttccctgttgaaaataacagaagagccgggcacggtggctcacacctgtaatcccagcactttgggaggccaaggtgggcggattgcctgaggtcaagagttcaagaccaacatggtgaaaccccgtctctactaaaaatacaaaaaaattagccaggcatggtggcgtgcgcctgtaattccagctacttggaggctgaggcaagggaattgcttgaaccagggaggtggaggttgcagtgagctgagatcgggccactgcactccagcctggatgacaaaatgacacagcaatactctgtctaaaaaaaaaaaaaaaagaaagaaagaaagaaaagaaagtaacagaagagactctcccagcccatctcacttccttttcctagagcacttacttttggaaacctgtaatcagtagttctttctctgtctcttttaaatgtatgtaaatcttttgaaaagctaaataagcctcttgccaactttaggacccaggtatgtctttctccaaggacctgggaatcatccctttgaaaggtaatcatcaaggaacatagctccccatcttctagtctctagagaagcataggagcctaacttcagctccaacttgcaaaactaccttttgccataaagaaataagaagtttatttttcctttggataaaggcaattagcaaacacagatggccactccaataaccaggagactttagaatgaactatgtgtgacaaatagaactagtcccctgaaaactagttattgtttaacgtgagaacacgtatgtaacagattggagctgcttggctggacaaaaggtaagactcctttctgtctttgcaatctcttcgcagatcacctggcatgcgcgtcccattctggttgaatgcttgtgcaataataaaactgttttctttcttttcaacctttgtgaagaggttttctgagttgagagattttgtctgtaattatcgttccccagcaattcttgtgctctcctaaagagaggatacccaggcctttcaggaggagggaggctgaggtagcaccactggcaggggagggaaggaggaaggagagaggaggggcatgcaggccctgccaaggtcagacacagctggtatagcagagcctgggcatcatccaaaagaaacaggctcaatccatcctgtacagttccccggcttccccagcccccagcccgtcttccttcccaggctctctgccctgggttcacttgccctcctttatgcatcgaatgttaaacttcttttgttttccccttcagcagttcttgcccgctttgcatacagatgctgtgtgtaatagatgcacggtaagattccattctctacctgtccgccaagtcccctttgtttccacagtgaacctcattcatctggaccccattcatgacattttcaaaaatcactttcctaagcaaagactaaagtgtattttgctttttctgtaaaggaagatgatgtcaagtaaatttatcaacaaacttgctgggagccactcaattgacttgagatcaggaattgtttttgaacatttgatgacaactttgcatactggattgtcaaatattgattatttttctcctccaccctcactccccacagcttaaatgggaccccaggcactgccctagtcaggttgggggctagttggctacctaaggggaaggcctgaagaagcaatttggtttaagcctttgagctctaattctcaacactggctgcatttcagaatcaccagaggggctttaaagtatatatgtgaatgtgcagatcccacccccagcgtttctgtcttaattgaggcgtggtggtgcccagggcagcatctgccttgacagctcccgggtgggagtctctatcacatctgtcagtcagtgctccctgtgagttcagaagcctagaggtaaaggcctctcaactctagttgctcattacagcaccgagagagctttttaaaaatatgaatgctggcccggcgtggtggctcatgcctataatcccagcactttgggaggtcgaggtgagtggatcccttgagcctaggagttcaagactagcctggacaacatagtaaaaccccatctctacaaaaaattagctgagggtggtggcacgggaggctgaggtgggaggatcacctgagcctgggaggttggggctacagtgagccgtgatcaagctgctgtacttcagcctgggcaacagaacaagacacagtctcaaaaaaaaaaaaacccaaccaaacaaacaaaacaaattgaatgcctgtcacaaagcccagcgattctagttttattgggctggactgagacctgggcaccgggagcctctgatgcgtagccagagtgagactcactgggagaggggaaagaaccgtgacttctcagtaagactgactaagcctagtgtctgggctctgctgggtaagtgtaagcaggttgattcacctctctgagcctcaattttctcatttccaacattggagtgctgcaacccaccatgcagggttgactgcagctggtgtcttccacctgcatggcctgcgttagctctctcagtagttctccttgtcagaaagtggacatttaccattagtaattaactatgttaccaataagaattcagttcttatcaatagaaaggtgctgcttttggggatgtgaaaaagaagatgccagggcccgcctgtcctcccagtctttgacaagtgtcaggacagtggctcttttccatctctcataaaatcctgtttcaggaggctggctcttttgaatcaaattgtacttaattaaatcctccctgaaactcaggggagtttcataggaactctgcatatatttacagcctttggccaggcacggaggtttgcgcctataatctcagcactttaagaggccaaggtgagagcattgcttgagcccaggagttcaagaacacctgggcaacatagggagacccccctgtctctaccaaaaataaataaataaattaattaattaattaattaattagctaagtgtggtgacatacacatatggtcctagctattcgggaggctgagttgggaggagagacagagcatgggaggttgaagaggcagtgagctgcgatcttgccactgcactccagtctgggcaacagagagagacctcttctaaaagaaaaaccggctgggcatgatggctcacgcctgtaatcccagcactttgggaggccaaggtgagtggatcacctgaggttgggagttcgagaccagcctggccagcatggtgaagtcttgtctctactaaaaatacaaaaattagccaggcatggtggcgggtgcctgtaattccagctactcaggaggctgaggcagcagaatcacttgaacccaggaggtggaggttgcagtgagccaagatcactccattacactccagcctgggcgacaagggcaaaactccgtctcaaaaaaaaaaaaaaaaagaacccaaaaaccaaaagttctgcatgctagatcttattgtaaagaatgcatatttgtattacaaaataaatgaaaagcaagttagctcaggaactgagcctggaacttactatcagatcacatggattccagagcatctgtgtgtgtttggctaacacccctcaccccttccagcctccatttgctccactaaattttagactgcgattctgaaaagtggggttgaaaatcctgttgctgctacgaagactgtgcaattctatagctcattcctaatgtcattgtcagcaggccaaggatgcagtttcacagccctgctgggtgtgaccgaaaggctttctctaagtgtgccctttcattaaactttctgaaactgctattggctttgcactcagcgaggtgcagaaagggataaagataaaacagatacagattctgcctacctgccctcaaatagattgaggtttggaagttcagacaggtcatgcatgtaactaactctaacacgcagtagagaagaggtctggctgggagtcggggcaggcttgctagaggagggagtattttaaccatgcatcaaggaagagcggagtatgggtaacggggcaggtgatgcccttgtcctaatgtcaaggatgccaaggtccaggatgtaaggaggcaggaggcagttcccggagatcttggattatttttaggaggggtgaaatagctggtcaacaggtatgcatgttttaaggtctttactgcaccttgcccaagtgtcctccagaaaggatgctccaatgtacacttagccagatattaagatgcctggagccttggtctgaaaatgcaggaggaagaggtgcaggggctgtgaggtggagcggagtttgtcctgtcagctcaacaaatatctttcatcactgggctgtctgtgtggtgtgcagagatgaaaaatggacacattcctgccctcagggagctcaacctactgggagagatagaccacagcccaaaagtgtgggcaaacctagggctcccttgaaagttataagcaggtgttgtttgtttgttttgagaaagggtctccctctgtcgcccaggctagagtgcaatggcaagatcacagctcactgcagcctcaaagtcccagggtgaagcgatcttcccacttcagcctcccaagtagctggaaccataggctcatgccaccatacccaggtaattttcttttttttagagaccacgtctcactatattgcccaagctggtctcaaactcctgggctcaatcaatcctcccgcctcaacctcgcaaagtgctgggattgcaggtgtgagtcatccagcctggcctacgagcaggtttttgagctgaaaagagtctgtcctttctggattctccctctttgaggcacctcattcacctcagtggaattattcacagggttccaccagtaatccttgggttccctgactctccaaaaggcatctaagcttcctggcttcatattgcctgactctactccctcccacatttctttgtcccagctatttaacttcagcactggaggaatctccaaggtgcttgaagagttctgcccagcttcccgcaaggctgtgccttctcaggtcatcgagcaaggaagccatccctgagagtctcatccgagagcccttgcagtgggcatccaaggccataaatatttgcatgcctgtgaacccagctttcagaaatgatcttaaggaaataagcatgagtatttgcagagatttatctataagattatgcatgagagccttatttataaaagagaaaaatcattgaaaatgacctaaattttcattcatagagtttgactaaataatttatggcatattcacacaatgcaggagttgtaaattacatcatggaagaatatttaatgacatgaaaagaaacttaaggcatttgcaaaatactgtgtactacatgatactatttctgatagtaaaaaatatatacaaacgtagagacacaagggagagagaaaagtcatgtatcaaaaatataaaactttcatgatttcagggtagtggattaataagaaattttaattctcttttctggatgttttctatgatgttcactatttgtttaatcagaataaaagatactctatttttgaaaatgatatctcctggcacaggacaatgattcccatctgaggcacatgcgggtaggaggtgggtgctggggagctgcactgcttaggccaggagagtccccctgagctcccggctgctgggacacacttctcagccatgccctcctctgcaaagtgccatacagcaaccctggttatgcaacaagctgcctcggccctgggcaaacagatcctctgactcctcggctccattacaggccataatgggacaaccagacctcaggcccgatggttgcataaaagcaggatggatagatttttctggtcactgtgttccacccagctgagcaggcatattcagactccttccctgctgtactgcttagctcatgcgaagcaggagccttcttcaggcagccttccggactaactccactatgccgtgtgcttcaaaagcccctgctctaatccataatgaacacttgcagagtactctacttgtaataatccaaacgattctcatgacaacactataagtgggtactgtgatgcttttgtgacaaatgaagcaacggaggcagagagagcacaagcgattacccaaagtactatgcagagccaggattcaaacccaggcagtgcagccccagggtcagcccggaagacaccacgccatgcagccccctggcagataattgctatcacagccacatttgcatggtgattctgagttgtttccaaatttttgctggaagactatggattcctcgaaggcatgaattgtgactttcacttccgtgggaccatccagggcccagcagagcactgagtgcacagggccttcccaggggcttgcattctcggctctgaagcccgccttctttcctactccagctgcaggtgcaagtggtgaatcctactgagccataatcttgctgctagaggcttatctagaggtgcttatgcaagcagtctggcaaaacacctctttagggacaaacgtagagctggagacttgggacgcctcaggatgtgtcagatcacagctttctgcagggcacaaggcttcttgctgcttctccagaacatctctccaaatgcctgtgcagccctgggtacctgggcagggtccagctctacaaaggatcatggctcgagtccttccgctccaatgggaaagaccaaccaagtgagagaaagagcatgccgcccagagggggagctggttgccattgtcctcttggctgtcatttgtttcttcagggtttccaggctggcttccaaccgaggatgtaagaggctgttaccaagtccaggcagatcagcacaaacatattaacaggggttatctcagcgtggtgtgatgagggatgactttttctcatggctttgcttctctgccttttctaattttctgcaatgcacatgattatttgggcaattaaataattacagggaggggaaagtcactgttcttgctttgtcccttgcaggactctttccccacacttatatgggctgctaagctccaatgtgccctctattgcatgtggcttccaccgagctctttctgatcttcacaccagcaaactcccatctctactctgtcctttccacacccttcactgtgtactgatctgctcaaatccttgcagattataaaatgtttcactggcccgagcctgctggtccccacaaccctgatttcaaaagaagtcatcttttgtgtccttgcagagcgtgcctggattgtgtctctatccttggtcccttacctggactgtagccccagttaactgctgaataccagcagctgggtgtcctcagcaaccatgtccacatgaagcatcttagtctcacccactccttctgtgtctctacgagcagcattgagctgtagatgggaaagtgtatggaaatatgatcactttttccctagggcaaagagggttggtgttcttttcttcaaaatttattttgaatctgtcttttctgtctccccactacccctcactcatgctcctgagtcactgctgagctccagggctgtacctttctcattttggaatctctaggatctagcatagtacccagtgcacagtatgccttcaatgtatgcctcttggttcaatgaatgaatgcatgaaaaaatgggcaaataagtaagttttaataatttgtcaccttgatttttatttcttgcaatccttcctgtatttcttgcaatccttgttttattccttgcaatccttcctatatgtctctgccagttgaatcttccaaagtggtgactcgaccacgtgaatctcctctggtgactttaatggctcccactgtctgcgaaggcctttcaaaacccagctgcttgttacctttctttgcaaggattttctctctcactcctcaaagctccattctggctgacttggcctctctgtatcctttcctgcccttgttgagttgcccttttctctgtgtagccacttagctgcctgtgctgatacttgctgctggctaagcttgtcataagttcagtgtgacaccctttcccgtgatgggctgattacagtaaggtcccaatctagtggtgcctccctctattgctgggttgggtaatctcccagttactctgggtttgaccatgtgacttgctttggtcaacaggaaacaggatgttagcagagacttgaaaagtgcttgctcattggggtttgccatcttttgctgctctagggaatccagcagctgtcaccatgtaaacaagcccaggctagaccagttaccctcatcatcttagctgatagccagccagccaccacaggcatgagtcaggccatattgctggacccacagaattatgagctaaataaatagtcttgggttaagccactaagttttaggcatagtgtgttatgtatctcacaaacatataagactgtgtgtttgttgactggaggaagagatgctataaagaccaccttttaaaacttcccaaatactgccactgatgtcctgatggaggtatgaaaacatccactaaaatttgtggtttattcatttttcattattttgtttaaggaggtctatagtggaagagggagatatttggggaaattttgtatagactagctttcacgatgttagggaattattattgtgtgataatggtcttgcagttacacagaaattcttccttattttttgggaagcaccaaagtagggataaaatgtcatgatgtgtgcaatacactttaaaatgtttttgccaaaataattaatgaagcaaatatggaaaataataattattaaatctaggtgatgggtatattgtagttcactatagtattgcacacttttctgtatgtttaaatttttcatttaaaaaactttgagctagacaccaggctatgagctaggagcatagcaatgaccaaatagactcctaccaactcaaagaatgcacattctctgggaaacatgtttccattaggaagcctcgaatgcaatgtgactgtggtctccaggacctgtgtgatcctggcttttcctgttccctccgcatcatcactgcaggtgtgttttcccaagttttaaacatttaccttcccagtggccttgcgtctagaggaatccctgtatagtggtacatgaatataacacataacaaaaatcatctctatggtgtgtgttgttcctggggttcaattcagcaaattttccctgggcacccatgtgttcttggcactggaaaagtaccgggactgaaacagttgatggcccaatccctgtcctcttaaaacctaagggaggagatggaaaggggcacccaacccagactgagagacaggaattagctgcaaggggaactaggaaaagcttctttaaggatggagaggccctagtggaatggggagattcttccgggagaagcgatggatgcacagttgggcatccccacagacggactggaaagaaaaaaggcctggaggaatcaatgtgcaatgtatgtgtgttccctggttcaagggctgggaactttctctaaagggccaggtagaaaacattttaggctttctaagccaaggcaaaattgaggatattacatgggtacttatacaacaagaataaacaatttacacaattttttgttgacagaattcaaaactttatagacacagaaatgcaaatttcctgtaattttcccatgagaactattcttcttttgttttgttttgcgacagggttgcgctgatcctcccgcctcagtctccctaagtgctgagatgttgcaggaagtcagggaccccgaacagagagatcggctggagccgtggcagaggaacataaattttgaagatttcattttaatatggacacttatcagttcccaaataatacttttataattttttatgcctgtctttgctttaatctcttaatcctgttatcttcataagctaaggatgtacgtcacctcaggaccactgtgataattgtgttaactgtacagattgattgcaaaacatgtgtgtttgaacaatatgaaatcagtgcaccttgaaaaagagcagaataacagcaatttttagggaacaagggaagacaactataaggtctgactgcctgcggggtcgggcaaagggagccatatttttcttcttgcagagagcctataaatagacctgcaagtaggagagatattgctaatttcttttgctagcatggaatattaatattaacaccctgggaaaggaatgcattcctggggggaggtctataaatggccgctctgggaatgtctatcctacgcaatggagataaggactgagatacgccctggtctcctgcagtaccctcaggcttactagggtggtgaaaaactccgccctggtaaatttgtggtcagaccagttttctgctctcgaacactgttttctgttgtttaagatgtttatcaagacaatacgtgcaccgctgaacacagacccttatcagtagttctcctttttgccctttgaagcatgtgatctactccctgttttacaccccctcaccttttgaaacccttaataaaaaacttgctggtttgaggctcaggtgggcatcacagtactaccgatatgtgatgtcacccccggcggcccagctgtaaaattcctctctttgtactctctctctttatttctcagccagctgacacttatggaaaatagaaagaacctacgttgaaatattgggggcaggttcccccaatatctggtgcccaacgtgggatactgagattacaagcatgagccactgcatctggcctcttcttttgatttttttttttcaaacttttacaaatgtagaaaccattcttagcttttgggcattaccaaacccggcagtggcaggctcggttcaccaacgtcatttgcagttccccgctttatgttatgggttttgttttgttttgttttttttattgagacagagtttcactcttgttgcccaggctgtagtgcaatggtctgatcttggctcactgcaacctccacttcccaggttcaagccattctcctgcctcagcctctcaagtagctgggattacagacactcaccaccacacctggctaattttgtatttttagtagagatgaggtttcaccatgttggccaggctggtctcgaaatcctgacctcaggtgatccacccaccttggcctcccaaagtgctgggattacaggcttgagctaccacgcctggctgggttggttctcaatggagtggtttgtttttggagctgctctgcgcagtggggaccagaataggcctgggttcctagcccattgctattccttaccagctgtggattctaaggaaagtcatttaacctcgctggaccttagattcctcatccctgaagcccaagggtaaaacaaaacaaaacaaaacaaaacaaaccaacccatcatgtaaagcggggaactacaaacgatacaggtgaaacatgcctaccacaccactcacaggctatgatgacaaaaacgtggctacatctgggaccaccccccaacccccactttgtacgtaggaaatacggagttgaggatggagacccacagtatgtccagagtgtccccaaaggccacagtgcccgcctggagccctccagagagcgtgcactccctggggtgccagccagagacaacttgccctgaggcttggaactcgattctccgcgtgccagagaaggggtgggacttcagaacccccaaccccgcaatctgggtcggggagcctggcgcactgcgggccgctccctctaaccctgggcttccctggcgtccagggccgtcggggccgagtcccgattcgctcccaccccgaagccgcgccaggaccaacgagggcgcagccgtatgccccagcccgctccgcggagcccctcacagccacccccgccccgaccgcgccccgcgcggctcgaagcaccttcccaaggggctggtccttgcgccatagtcgcgccggagcctctggagggacatcaaggatttctcgctcctaccagccacccccaaatttttgggaggtacccaagggtgcgcgcgtggctcctggcgcgccgaggccctccctcgaggccccgcgaggtgcacactgcgggcccagggctagcagccgcccggcacgtcgctaccctgaggggcggggcgggagctggcgctagaaatgcgccggggcctgcggggcagttgcgcaagttgtgatcgggccgctataagaggggcgggcaggcatggagccccgtaggaatcgcagcgccagcggttgcaaggtaaggccccggcgcgctccttcctccttctctgctggtctttcttggcaggccacagggccccacacaactctggatcccggggaaactgagtcaggagggatgcagggcggatggcttagttctggactatgatagctttgtaccgagttctagccagatagaaggttaccgggagctggggagcgttggatttgctgctgggctgtgccggtgcccagaaggcaggaccttgcagaaccagccaggtccctgggagactgtcagacccaccaacctggtggcattcgcagagctgagatgcattggaaattgccttgggcacatccccaaagatcaggatgtcccaccccagtctgaaggagataaagttgggggtaggagagacgcagatgcaagtgatcagtctcagtcccagacattgccttgctctgcgggtaggaattcaggattcattttccagggaagttcctgacctctgaatgagaggggctgtgtaaggccaatgcctgggaggaaggcaaggatgagtagaggtggggggaaacaagtgtcaggaagactcaaaatcttccagagaaattgtgcagggtcttaccagatctgtcctcaaagccatgcaaattgccttctttgcaatgcatacaatgaggtgtctctgggggtcagaactggttattagggaacttctagccaggactgctaaatacgcgctgttggcccaccaggctcacctatagccttccttcagtctgggcttggtttggatttcactgtgggtgccatcgcctttacactcctgtttctatagtttaaagatagtggtgctttgggaaagtgactccttaaatacagttaggtccaagtgagacaagtggcctggctgtcatttcagaatagcagcttccaagaggtgattaatttctgttggaagggtgatctttggggaggtgggtgaagagcagagacttggtggtaccgttccaggagcacaggctctcttcctttgcagtgcagaatgacctctggcagccggagttgtgtttgttctgtaggattctgaggtgggccatgggcagctggaactggggaattttgccaatctctttcatattaggattgtctgcagaaccagatatggaggcttctagcaacgtgagtgctcctgttctaatgcccttagaaacaagaaggccacactgatcatttctctcacttaggcagggagacaaggcaagagagaaacagtggatgcttttaggttctttcccttcccaagcagttgtggacattgggctgaggggaacatttccacattggctaaaggagcgtcctcctcatattttgtacattttatacccaaaataactcttcttggtatttggggaaatattttcctccccgtccattccaggaaatggctccaagtgccaaggacagagccagggaagttgcaatgaattcctgcccgtcagccccaggcagatgccttgcacgtctgagtggcccatgcagagcgtggaggtggccgccacggaacctgggtcaatgtcccacccccgcttagatgccaccaggggcgtgggagccaaggagagaagaggggctccaggaaggtagagtccttgtgtcttgtgcatctgtgaacagcactggtatgatttaaaggaaaattgagccaaattttccggcagtcagttaccccatccccaccggggtaggagtctggcagccgcagctccattctggccagtcggcagagagccttgaaattcttctttgtccacacagttgtctcagagaaacagagaggttgtttctgcttaaaaacaacacacttggtgtctgggcccacagactcctttgcacttattccacgtgtgacagccaatgtgcctcgttgcttagcagacagcatgttaccgtctttcctgctcagtttgttagctctatggaatggaatttataatcaatgcccataccaacatttcactaatatcataggagatttagtctccatctgggtgtacattacatttgctctggggtgctccaggctggggggttgccaaggaagagaagagaaaccgcagagaagacgggagggcagggcaggggtctctgagaaggggaggggtcccagagtgcaggagcaggagccaggctcatgaaaggggccacgggcgggagtatccagggacggcagtcaagatggagcacagcttaggaagctgaagggaatcctggcccacctgggtgctagagggcacataggaagtgcaggaagcagaccaaggtccccaagagagggagacctggacgctgaagcattttctgtctttattaagacaactccgtaagaattcctgctgggccaaagtgaattctaggatgcgactttaagatgggagcaagcgaaccattgaggaggcaggttaccctagttagccaatgcagatcgagaatgggaaatctttcatttattcatgcaacagatatttaacgaagccctgccgtgttccaggcctgtgatagatgctggaacaggtacagagatacaggtgtcattaattgatcagggcaacctctccttctgagtcttgctggagcttcagatgcccctcacacagagctcgagggagcctcaacaattgatcagaagtcaggcaccatggctcacgcatataatcccagcactttgggaggccaaggcaggtggatcactggagcccaggagttccagatcagctggggcaacatggcaaaaccccatctctattaaaaaaaaaaaaagtaactggatgtgatggtacacacctgtagtcccagctacttgggaggctgagaggtgggagaattgcttgagcccgggaagtcgggggtccagtgagccttgatcacaccactgcactccagcctgagtgacagagcaagaccctgacacacacacacacacacacacacacacacacacagattagagctgaaacaggagtagaaacctatctgtatctctgatgagatcagatctttctgatgaacagaaagaatgtaacccctgtactcacaccctctctgctggttacatatgttaacacgatttctcaaatgaggcttttggttgcaaataagagaaaatcactcacgctggccctgtgtttttcaaattgtttattgtgatcaacatttgaaaaaagagccgagactctcaagagtgcattacccacggtaagggtgaattttacttcttgacacttatttctcttacatgtatctatctgtctcaaatgaaaaatatatttagaaagttgaaagctatccaagtgagtataagaaaagagtatctcaccctgaaggctaaggacagggagggccaccaggcctcacgaggacccaggaaccacaaagaaggctaggaaggagcacaggcggtgaccatactctggctcagtggctatgtgggctctggtctctctcagctgttccatgcatatgaggccaaatgtggctaccctagagcttctgagccctcaacagagatgaactggactctctgcagccccactctaaattcctaagagagaagttgattgacccaatcagggtcaggagaaggaagggaggaggaaagggaggagagaagagcctcttcgtctcttgcctaccactggccaggcaattgtagccaagggggctggagtgtaaatgcaaacatagccatcaagggttgtgtatgtgtgtgtgtgtgtctgtgtgtgtgtatgtgtgtctcttgggtaggttagatctcccaggaggtccctactaaacagacttaagcccgcaaaattttagctctccagcctcacacactccacccctctaccatattgaatcttcccaaaccaactatggctttccctaactccggagcttggcctggaatgccctgcttcccctctttcccctggggaacgcctgtccttcaggcctcagttcacacactgcctcccttgcaaagctctcctcccatccccggagtccctcttcccctttgttctttgggttctatgcttcttccctcataactcccaccaggttgtgttaaaatgagttgttcaaggtcctgtctgttccactagattctgagcaacttggagaacgaagatccaaacttcgctgcctttatttcctcctttgttcttttctcatccccaagtcccttccaacttggagttatgaagaaaggaaggaaggaagggtgggagggaagaacaggaggggatcccacaggagaatgtgtatagggagaggactcagactagctaaagcttttccctcataattaatagcaaataccatgttacctgaatttaattcacagtagcatacaaaagactcgctttgttctccccattgatgtcatcagagggctgtgggcaggcctaatcttggctcaggaggccctccagcctggatctaaagagcagcagatgggccaggctcggtggctcatgcctgtaatcccagcattttgggaggccgaggcgggtggatcacgaggtcaggagtttgagaccagcctggccaagatggtgaagcctcgtctctactaaaaatacaaaaattagccaggtgcggtggtgggcgcctgtatttccagctacccgggaggctgaggaggctgaggcaggagaatcgcttgaacccgggaggcggaggttgcagtgagccgaggtcacgccactgcactctagcctgggcaacagagcaagactccgtcaaaaaaaaaataaaaaaataaaaaaataaaaaaaataaagaggagcacacatctctgcccatcctaactcccactttgacattgaggtccccaggatggagggtctgcctccatctgccttgtcccctgcaatggtgggaaggtgatggagctcaagtctagaggccaccagcttcttagggaggtaggaggtggagggtggggtgcgggccctgcacacaactgccaagtgaggatgggggtggggtccacctgaggataagtaacagtgaggctggtgcagaggacccaggtggaggtagacagcagaatttgtggtggggtggatggcacattatataagcctctcttgctgccctgtttactgagattgtttcattatcttttttggcttttgtttttaagagatggggtcttgctgtgtcacacaggctggagtgcactgtgtgatcatacctcactgcagcctcgacatcctgggctcaggcaaacctcccaccttggcctcccaagtagctgggaccacaagcgtttgccaccacactcagctatttttatttttatttttattttttttagagatggggtcttgctgtgtcgcccaggctggtcttgaactcctgggctcaagcgatcctcctgccttggcctcccaaagccctgggattataggctgagccaccacacccagccacatttcatctgtgcagctccaggggctccacattctactcttctcatttcttctccagggtacccatggcaagggatgagggtagaagatggggcagccaggccttgattaaaggagaaggaaggcagcctgtggagagggcagcccagggagtgcagagagaagtgggccatgagggagacagcagagtgcaggctgcgtcccaaatgagcatacagcccactgtgagcccaccatcttcctagagacccctctcctctccaggagctgcttcagtagcactcagaggaaagaatgatgctgtatcaacatttcagcagctcatcttttaactctaagaaaatggcagctcctaaatgttcaaaactgctttggaaacttctggagagaggttttgcagctcaggcagacagctgatcgcggcctttcttccaccccaacccatgctctccccatgctctcctgccacagctgcagcgggcccctgggtcctacatttgcagccctttgtctctgagctcagacttccaattccaagcggcagctgggcaggctcaccagcatgtccagccagtactaggacatcagcaggagcccaaccacctctttccaaaatctctcctcatgtctctcctagtttccatctccatccttctagtcagccaggctgaaaacatttgctcctcagggtgcagaagggaaagctttgcctcccttcctggtgctcactgcccctgcgattccagcccaagccctccccggctcctcaccctggtgtcagctggaagccaccatctcctaaacccacctgtgttcttccacctctgccagggctgccctctcctccaccttcacaaactcaattcctacccattctcaggtcccttatcaaatgccatctcctccatgatgcctccctgattcccctgctggaaataatggtgataacagctaaggcattggggttggctacgtgccaggcaaggagttggcactttacatgctttatctcatttcagccacataacatcgacaggtggcattatgattcatatcatccccatctgatagccaggaaaactgagtcccagagaggttagccactttcctagggccctgtgctctgactcaagcatagctctgaggaactctagcattcatcagtttaagcaccatgactttctttgctgagtcacccaaggcatttcttcatttaaatgttcttccttggccaggcgcagtggctcaggcccaatgcggtggctcacgcctgtaatctcaacactttgggaggccgaggtgggcagataatctgaggtcaggagttcaagaccagcctggccaacatggtgaaaccccatctctactaaaaatacaaaaaaatgaggctgggcgtgatgactcacacctgtaatcccagcactttgggaggccaaggcaggtggattacatgaggtcaggagttcgagaccagcctggccaacatggtgaaatcctatctctattaaaaatacaaaaaattagccaggcatggtggcaggcacctgtaatcccagctacttgggaggctgaggcaggaaaatggcttgaacccgggaggtggaggttgcagtgagccaaggttgcaccattgcactccagcctgggcaaaaagagggaaacatcgtctaaaaaagaaaaaaaaaaaattagccaggctgggtggtgcatgcccgtaattccagctactcaggaggatgaagcaagagaattgcttgaacccaggaggcagagattacagtgagctgagatcacaacactgcactccagcctaggtaaagaacaagactccatctcaaaaataaataaataaaaataaat

SEQ ID NO: 552 - DNA, 35617 bp, Homo sapiens
ccagggctttttccttaatggtattttcgatttttctccaatctttttaaaggaaccagattgtgacatttgcagagaggaggggtcccatagtttctcatcatggttaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacatacaagcagccctggtgagaaaagcactggcggcatggatgtccacgtgaacttatgttctttagctgccacaaaacagcatttgccctgtggctacattaataaagatatgggctttagaatagggaggtgctctacagtgatcattcattcaactgacatttgttgtctgctagggatatgactgcttttgcatttagaaagcatccttaaagtaaaaacagaaaaatgtctggggttatggtgcatacgttctagatgcaggcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctgcaaaagatagagggcacatttactgtgataacccagagtatcagccaagggggcttgaccttcaaggagttgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttatatgctgggacaattccatcagcccttctgcaaaggagcctatagccatttaatcaggagatgggataagtattaacattgggtgtgagctgacattgctgcccagattcctacagcaccattatgtcccccatcacactggggcttacagaggccagggaataaacctagatacattatgccccatggtggaatcaccagttccataaatcctgtcctggttatctccccattctctgagtgcataattggccttgatgcactggcaactggagtcaccccacactgtgtccctagtctggagagtaagggatctcactgtgctgaagcccaaagggaaacatccctcatccaagccaaaccagaagcaatattgtgcctcagggtgggtcttgtggagggtactgcaggtattataggggtggcactgccattacagacctgaacgatgtggggtggtgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcactatttcttaaagtaactgactagcccctaagtgacaagttgaatagcttgagcaccatccatcctggaaggggcagaagtttatcctcacagggataggctcacagggatgcgatgtggtgtggttttcctctctgctctcagaccctcagtcaacaacactattggcattcctgatccactggctcagaatttcagtacactatctgcctgggggacacacctgttggggaaggggatgaagtgtgggccctgaccatgggatcccctggtcgtatcaccacctgcgcctctcaagtgctgccaggcacacagagtcatggacaggactctacaggcacaattcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaatacataacatgaatacttaaataaatttatttatgcatgtatgtatgtatgtatttattttattcattatattcacccccagggtgattttgctcttcttacttccaaaatctggactctgcagggtaggaggtcctggtttcccaaagagggcaccctggcaaggagacaaatgagagtccatggaactacacattgtggttgcacccagggatatttgaatagtatgtgcccagagacaagcaggtgagaagaggaggaggcagcgctgctatcacacaatgagggcaggagaagtgtgtgtggaaaccaggaatccacttggggacgtcctggtttcccttgtccgttgtgtgagcggaatcatccagcaacccagcctgagagggtttgatattcaagagcccagaaccctcaggaaggaaggattgagtgatactcctaggtaatgtcccacgtctctgcttctgtgctctgacatcctcagcaggattagtgcagaagccctgcttccatgagttgttcccagccagtgaccggtcacagcaagcacactaaggcaggccattactgggagacatgggactcctctgatggccaaatgtggctccaggactcctccatgcccttcctcaactctccttagactgcctctgctctaggatgcgtcgaacagaccttgtctccttctgtccagcacttggggtcacacttgcatcattgtctgccgccttttccagggatttctggctcgcgtctcatattcccttacaggtgtgtcccctcataagatgccgtagactttaagctcatcttggcatctgctccttggaggacttggactaaaaagcattgccatgtgcacaccaataactcttacttattccaacctgtaaaatccatctctttaaccaacttctgccacccccataaaatctattttgcgcgcgttcgtagtatctctttgaattaacagatatttgttgtattaagccactaaattttgaggtagtttgtgacacagcagttaataactattaaggctttcttaagtttctgttattccatggatgttatctacatcttttaatttcctgcattttaataatattagccacacttgctgtttctaatcctttcctcctattcttttttgaaaatgttcattttgtctttctctgtccttccatctttctttcctcctttcctccctcagagctttctccctccctccactttttcataaactctatgtggttaggctaaaaagaatcactatttgaatcttatgcttaaagtataatgccataatttacaggataaaagtaaagaaaaggaaggtattaatggaatatgaaaaaatgcctagggtgattctgtagccaagacaatggttttttaacatgtaatctccaccttcaactgaatgttttcagaacacatgagcaacataagttctttcccattcttggtacaagcacttgggaaatcaaattagccttatcttgtatgattaatgtccatacactgtataatcccaccatctgctcctgatcatacactctggggatatctttggctatgtgtcccagagacgtgtacaccaatgtttatggcaaaaaaactggaaacaatcacatatgcatcaatgggaattaacaaaattctgatataattacgaaaagtaaaattttagcagtaaaaatgattgaacagcaccctcccacatcagagataactctcctacacataacatgcatcacagaagaatacatatagtgtgagttctctgtacagcgaagttaaaaaaacaggtcagactgtgatttgggtatatatatttattgtaaaaatctttagagacagtgcaaaggactagtaaatacaagactcaagatagaggttccttttggtggataggattgggcaacagtctagggtggcttcataggttctgtttcttatgccaggagaggatgtccaggtaattagttacttgatcataaatctttatttatttatttattcatttatttttgagatggagtctcactcttgttgcccaagcgggagtgcaatggtgtgatctcgtctcactgcaacctccgcctcccatgttcaagcgattctcctacctcagcctctgagtagctaggattacaggcacctgccatgatgcccggctaatttttgtatttttcgtacagactgtgcttcaccatgttggccaggctggtctccaactcctgatctcaggtgatccacccacttcggcctcccaaaatgctgggattagaagcatgagccaccactcctggcccacaaatatttatagtggcaattttcaaaatgcaccttgtgtgccattcctgattatttggaaatgaaagagaaaagaaaacacaaaagttcattgcaaggatccttagcaataactacatgagttaaaacaaagccacagccaattgtaaggagccatgtgacagagagtaccaggatgccatgaaaaaatagcctttgatagaaataggtcatttgattcttggctaattggcaactctctacattctctggtgtacaatgttcaatctgatgtgcaaggcaattgtatctcgcaaagaatttgagaatttgatatgttgctcaattttaccacggatacaagtgaattaaacttttacagaatagaaaaaaagcactgtcgagcaaaataaattaaatgaaaacacataaaggaataactagtgatgaaatagcaatacgaatggaaaacacgaaagagcttcttttacagcaacattagaagcacaaaataactgtatttttcagaatcatactggagtccaaatcacttctaccacatctaattaaaaaacacagcgaaagatgttaaattgatcaatggatgcacactgaatacccagttattgaaaaatcgtgttcctagattggagttaaccatttccgcctaccacatcaaaccaaatctttgtcgtgatgctaagctagctgtacagacaaagatgtgagacacattttctctaactgcaaagcaccctgattaggcaaatatttttgtagaagcttgagtaagaaaattgacattttgggcattcttaaaaggaattagtagcttctgaggaaaaagaaagatagttatgattgtaaaggcattattatacggcaccagtcgtgggactctttggtctagctactgtattttctcaactttcttgcaactcatcaaagagaacattaatattaaaggcatttgcaaaaaaaatctgagatattgttgtatctccattctctgtctcaaagttttattcattactttacaaaagataattttaaagtattaaagaaaattagtcagatacaagaagtatttgatttacaaaatcctgaaacaataatgttaattgtggtgccagctacttgggaggctgaaggaggagcattgatggcatgagcccaggaggttgaggcttcagtgaatcatgagcatgccactgcattccagccagggcaacagagtgttactttgtctaaaaataactaactagctaactaactaactaaataaataaataatggaggcagtgcacgagccctggtgaagggcactttggctgcattgagcacttgcagatttgaggtgattacattctgtacgttacttaacatgcatactgtacatacttaacatgcatataaattctttgatactcctccttgcagaggtgcagcttcattcccttcctgtgagtgtggcctgaacttaatgactcacttacagactgatagagtaatgttgagataatagtttgtgactctgggtgtagatcataagactcactaagtctgggagcggtcactcacgcctgtaatcccaacactttgggaggtcaagagggcagatcatgaagtcagaagttcgagaccagcctggccaagatggtgaaaccccgtctctactaaaaatacaaaaattagccaggtgtggtggtgcatgcctgtaatcccagttgctcaggaggctgaggcaggagaatcacttgaacctggaagtcggaggttgcagtgagccaagatccagccactgcattccagcctgggtgacagggtgagactctgtctcaaaaaacaaacaaacaaacaaacaaacaaacaaacaaacaaaaaactcactgcagcttcctactttggttctggttttctctttctctgggatcatgagccttgggggaagccagctgctgtgtcataagcaggcctgtggaaagctccaagtgactaggaagtgaggcctcctggggccagacaataagaagatgaagcctcttccaacagccacgtgggatattcttgtgacttgtgaatccccagccccatttgagccctcagatgataaagccctggatgacaattagaccgcaattttgtgagtggccctgagccagaagaactttgagaaaactttcctggattcctgaccactagaaactgtgggacatgataaatatttgttgattttagttgctaagttttaagtgacttgttatgcatcagtagataactaacacaccttcacaagagaggatgaatcattgaatttttcatttgctctaaattgattataagatattaaacatgtcatttgcttttaatatttaacaagaattttcatggttatataagatatattttattatcactaacaatgatcaattttttttaccttcaatttgtatgttctattcaaacacaaaaggaagagccaggctatgctagggtgattctatgatgacaccccaataaccacccttggttgctcacattaccccagttactcggttgacactaatgtaggtgctgctgtgaagggattttgcagatgtattccaggtcccctgtcagttggctttaagatggggattatcctgcttggactgtcctaatcaggtaagctctgaaaaggactgggttcttcctgagaatagagactcacagtgtgagagggattcagtgtgaggggcttcctccattgtgggctttgaaaatggtgggatcatggtgaaagaacactggtggccaataggaagtagaagccctccccactgtctactctgatagcctgaaggaaacagggaccttagtcctacaattaccagaaaccgaattctgccaacgagctctatataagcttgggggagaatcccaatcttaagatgaggatacagctttgcgaaaccctgaacaaagaatctctgacactaggcctggatttctgatgaaggaaatgcagaaaaataaatgagtgctcttttaagccactaagtttgtggtaattggttatgtactaatagaaaattcataaacagattcaacagctaagcatatgacatttcctccaatggaatgaatttatgaactgatatgcatagtagttgcataaaaccaaatgtttcctaacttgctttgcatttttcattttgtgatttttgtgtgatacaatttttaacacaatcatatttcattcactcaagaaaattaacttagtgcctactatgtgccagatatgcttttagatgctgcagacacaactttgatcaaaacaacccaaagcccctgtgcttgtgccttccattttagaggcttcttgagagtgagatggagccattggagtgttttaagtgaagaaatgacacaatctgactcacattagcaggatttctgaccattgttgggagaacagtcatgggcagcaggcgaggggacagagctagggccgcaattcagtagtgacagagtagtagagactaaggggagaggagggcctgatgggtgacagggacagagagaagggctggagaagcaggaggtgaggtaaaggaacagagagaaagaattctaaagcaatggaattctcagacttaaacacagggttttatagatttttaatccatttatcctcagagcctggcacagtgttacttgcaccttggtctttaatacattctgtggggctgtctaataactaattgcctccttatgataaacaggttagaaaagaataccaggtgtcccaataaaatatgcacatagcttagatgtgaataattcctaaatataggcaggtgcatgagatggtcattgtggctcatgcctgtaataccagcattttgggaggctgaggcaggaggatcatttgagctcaggagttcaagactagcgagagcaacatagggagacctcatttctacaaatttttttttagaaaaattagccaggagtggtggtacaagcctgtggtgccagatacttggaggctgaaggaggagcattgatcgcatgagcccaggaggtcgaggcttcagtgagtcatgaacgtgccacagcactccagctagggcaacagagtgatactcggtctaaaaataactaactaactaaataaatgataaataaaggcggtgcatgagcactggtgaagggcactttggctgcattgagcacttgcaaatttgaggtgattaaattctgtacaggctcctggttgcaatatacggtaacacattgtgctttgtattgagatgtcctggactcgcgcacacaaactcagggctataagataaagataatttaaaaatacaacagaccagagtcacagatacacagtctgggaaagtaaaacttaactttgtgagtctaactgcaatgcgtttagacacatttatatataatggggccaaaaatcacctcttttacaaattagattcgtgaccattcaggggctaccaagattgtgctagccactgtactgcgctacccactgttactaagattgtgctactccgctgcgggaccagcggagatcctccacccaataaaagccccaggcgcctataccggattccattttcagttcaggcccaaatccccgggggttggtcgaggctgaggcggggctccgtcgaggctgaggcggggctcagcggcctgggctgaccgcagtcgctgggaatgggtctcacacccttcaatgggtacacagctgcgacgtggactcggactgcagtctcctcagtgggtatgaacataccctatcacggcgccagttacctcgtccgaaaccaggaactgcgctcttggactgcagcggacaaggcggctcagatgccctggcggaggaacaggcagagctgctcaaaacctacctgcagggaaggtgggcggagtggctcagcaaagtccttaagaatgggaaggagaggctgcagtgcccaggtaccagtggccacggggtgcctccctgatctcctgcagatctccttgagtcacattccaaaagaagggaaggaaaatgggaccaacgctaaaatatccctctccctcttgtgaggaggaagagtcctcccgggttttcagatcctatactagagagtgactgagggcctgccctgcactctgggacagttaaaggatgtagtctctgagggaaaggaggggaagacaatccctgaaatactgatccgcggtcccctttgtccccacagcagccttgggcaccaggaattttcctctcaggccttgttctctgcctcacactcaatgtgtatttgtgggtctgattccagcttttttgacctcggcctccgctcaggtcaggaccagaaatctctgttccggcctcagacactaaaactttctaaggaatagaagattgccccaggtgcctgtgtctagactggtgtctgagttgctcccttccccacttcaggtgtcccgtcaattttcaggatggtcccatgaggtggaatgtcccatgaggaatgcaaagtgcctgaattttctgactcttcccctcagaaccccaaagactcacatgacccaccaccccatctctgaccatgaggccaccctgaggtgctgggctctgggcttctaccctgtggagatcacactgacccagtagtgggatggacaggaccaaatgtaggatgcagaggttgtggagaccacacctgcagggtacagaaccttccagaagtgggcagctgtggtggtgtcttctggagaggagcagagatacacatgccatgtgcagcacgatgggctgccagagcccctcaccctgagatgggtaaggaaggggatgaggggtcatgtctcttctcacgggaactaggagcccttctggagcccttcagcaaggtcagggtttgaggcctgatggtcagggcccctcacgttcccctcctttcttacagctgtcttcccagcccaccagccccatcatgggcatcgttactgtcctggttgttcttggtgctgttttcaccagagctgtggtcactgctgtgatgtgaagaataagagcccaggtaggaaaggggtgagctccgagttttcttcttccattggtggattcccagccccagatgggagttggcttgtatcctgcctagtcatgaggcaccatctctgtctatcaacacttactcttttgtaaagaacttgtgaaaatgaaggacaaatttatcaccttcattggagtcatgggaacctgactcccagcagtcacaggtcaggggaaggtacccgcagaggacagacctcactaggacaattagtccagtttcaacacatcctcttacctagggtttcctgattctgacctgggtctgcagtcacagttctggacactcctctgggatctcatgaccctgcttcctccctggcctttcacagtttattttctttccacagatggaaaaggaggcagctatgctaaggcttcatgcaagtgtggtaggggtgggaagagtgatccctgagatccttgggatagtgtagacaggagcccatgggggagctcaccaccccaaaattcctcctttagtcacatcatctgtgggctctgaccagattttgtttttgttccacccgaaacagggacagtacccagggctctgatgtgtctctcaaggcttgtaaaatgacaacttagggggcctgaagggaaggaggagttggggcataggggacacaactaggctctggagattctttgatttggaatttttcagggtgtggtgggctgttcagtgtcacaacttactatgactgatctgaatttgttcatgactattttttttctaagactgccttgtgagggactgagatgcaagatttgttcatgcctcccctttgtgacttcaagggcctctgtcttctctttctgccaaggtgtctgaatgtgtctacatccctggtatcatgtgagaagtggggagaccagcccaccctcatgtccaccatcacccctgatattgtttggatctgtgtctccacccaaatctcatgttcacttgtaatcactaaggttggaggtggcacctcagggaggtgattggctcatgaggatggatccttcatgaatagtttaggaccatctctttggtgctgttcttgtgatagttctcacaacgtctggtgtttaaaagtgtgtggtacctccctgctctctctccctcctactccaggcttgtaagtcatgcctacttccccttaaccttccagcatgattgaaaatttcctgaggtcctctcataagttgagcagatgccagaatcatactttcatatagcctgcagaaccatgagccaatttaaaccttctgtctttataaattacccagtctcaggtatttctttataacagttgagaatgaataattcagaaaatcggtaccagaagttgggtactgcaataaacgtagctgaaaatgtgaaaatgtctttggaactgggtaacaggtagaggttggaagagtttggagagtttagaagacaagaaaatgggggaaaacttgcaacttcctagaggtttgttaaattgttgtgaccaaaatgctgatagtgatatagacaatagagcccaggctgatgaggtctcagatggagatgaggaacttactgggacctagagaaaaggtcacttttgttatgcattggcaaagaacttggaggcattctgccccctccttagggatctgtggaactttgaacatgagggtgatgattaagggtatctgatagaagaaatttctaagcagcatagcattcaagatttggcttcctgttgtaatagtctatgcacatatgtgtgagcaaaaaaatgatctgaaactggaactgatatttaaaggggaaatttaatatccaggacaattcccagtggagctgcaggagcaggacccctatcaggactactaaatggtggagccactggcaatgtgcaagctcagcttggaaaatccataggtattcaattttcacccatgagagcagctatatgggttatgttcagcaaacccaaggatgtggggctgcaaatggcattgtgagcccaccacttgaaccagtgtgctcaggattcaagatatagggtcaaaggagattattttagagctttaaattttaacatcttccatgatgagtttcagctttgtgaggacactgcattcatttcttttggcccatttattccttttagaatggaaatgtataagaaatgtctcttccactcttgtattaatattttagaagtaaataacctttttaaaactttacaggctcacagctatagggacttaccttgagtctcagatgagactttggaattttgagttgatgctggaacaacctagcacatttgggacaattgggaaattatcatattttgcaatgggagaaaaacatgagctctggctggctagggacagaatgtaatgatataaatatttacccccgatacctcatgttaaaatctgacccccagtgttggacgtggggcctaatgggtgctgtttgggtcatgggggccaatcttttatgaataaagagatcctgtcctctctcgcaagtgaatgaattgttactcttttagtttccaagagagacagttgttaaaaagagcctggcaacttcctaagctctctgttcctctcttaccgtgtgatctctgcacataccagctcccctttgccttctgccatgagtgggagcagcctgaggccctcaccaaatgctcaaacatttccagacatcagaatcccaagccacatgaaccttgtttatataaattagtcagtctctgacatttctttatagcaacacaaaatggaataagacagcgctctcatcacaggtatgtgtctctggcattcagcccccattctcaagatatccagggtccgctcagccatgagtcctctcatcaatattctaactcttatcactcaagagattctaaggtttttaggagaaaccagggacaaagactaaatgtttttgttatacctcagattacccgcttttctttgaccacatatcttttataggaaaaggattataaaagtaaagaggtattggcgtattatcagagtctcattcagtcattcaaaattagaacagttcaccatcctctcgtatgaatatgtctcccagaatgaagtcactcaggtttgcagacaccactcaaccttaccaggctccaaaaacaagaatggtctcaaggacatatggcttcactcttttaggcacccagtataattgacctaagagacaatatcttctcttgctcacagcacttttgaggagttaagctaatattgaattttcctcattatataaccctttgatttagtcacttaccctcagccattattcctccttctgtccctttatatcagtcttttccagttttagaggtgacatcaggtttgtctgctgtgctgacctagactgcaggcagcaatagtattctagcatgccttccctcggtctactcttggtcatagagggtaggttatgtaggtaaggaactagtgggggccatctgaccaccaggctatatagctctatttactgttaatcctgactttgccagatgaaatgaaggcatagcaccatctttgagttgcttgagaattcttatataaagatgtaaatatatagttatggtttttggcttaaagataattcctgtttctggcactttgattttcatccctattcctggtaccactgcatcacatatgaaaaaagaaatttgaggtgaagcgtagtcattattccagcatcctctccccttcagaagaattgtatgtatagtcataacagcatcatcctgatccatcaggtaaaagagaggaagctatctagaggagtcactcttgcagccccacccatgtggacagtgagcacattcatgaagatgtaaaagccagtccttcatgtttatattgcccaacaactatattgccagtttttagacaaacaatgcttcaactgaccatttcaattttctatcaaagttttcttctgaggaggacatctccctgtgcattgttagccatttgaggctgtaaagtgtgttttcttgcgtaaagaaatgggactcagcagtccacattggtgcaatctctttttttctggtgatttcatagcccttgaagcattgacctcttcccctggttgagcatagcccaatccagagtcagtgactttcctgtcaagatcccttggcagctcctttggggttgctgccatcagtctggcttgccagccatgtatgatcaaagccttcccactagagaatcacatagccatctgctgcctctgtctgttttcttgaccaacagtcaaaacagagatgataagaaatgagataaattaccaaaattgtgaacaaaagagagattatcactagtgaccctttagaaattcaaaagcattataagtgaagactctgaaaaacctgaagtcaataagttagaccacttagataaaatggacagattcatacaaagatagaaattgccaaaactgactcaaaaataactagaaaacctgaaataaggaaaaacaaaaaataataatgtattgcttgctgttttatctggcctaaaaagcccatttgtcagccttcagtcctttggcctaagtttagctcaaataaggactgtatatgccaagctttaattctctatgtgaatgataaaaccccatcttcacaagaggagatgggttatgctgtttgttggattagtgaattaagccccgtgttcccccttaaagagaaataaaaagagcatagtaaagagccctcacccagtgaaaagccctgggatcccctaacacgcttgccctacaccctatacatctcacaaagtagaggacagggagatcagggggcaaaaggaaggtcggaggaaaaggatttgggaggtcatgaaggagctaaacccaatgctcccttaaatccttatccaaacttgaggaaagaattagaacaatgtaaggaaggacaaacctgataaaaacaagcaatggggaaaggattcccgatttaataaatggtgttgggaaaactggctagccatatgcagaaaactgaaactggaccccctccttacaccttatacaaaaatcaactcaagatggattaaagacttaaacataagacctaaaactgtaaaaaccctagaagaaaacctaggcaataccattcaggacataggcatgggcgaagacttcatgactaaaacacaaaaagcaatggcaacgaaagccagaattgactaatgggatctaattaaactcaagagcttctgcacagcaaaagaaactatcatcagagtgaacaggccacctatggaatgggagaaaatttttgcaatctgtccatctgacaaagggctaatatccagaatctacaaagaacttaatttacatgaaaaaaacaaacaactccatcaaaaagtgggcgacggatatgaaaagacacttctcaaaagaagacatttatgtagtcaacaaacatatgaaaaaaggcccatagtcacttatcattagagaaatgcaaatcaaaaccacaatgagataccatctcacaccaattagaatggcgatcattaaaaagtcaggaaacaacagatgctggagaggatgtggagaaataggaacgcttttacactgttggtcggagtgtaaattagttcaaccatcgtggaagataatgtggcaattcctcaaggatctagaaccagaaataccatttgacccagcaatcccacaatcccactactggatatatacccaaaggattataaacattttactataaagatacatacacacatatgtttattgcggcactgttcacaatagcaaagacttggaaccaatccaaatgcccatcaatgatagactgaataaagaaaatgtggcacatatacaccatggaatactatgcagccataaaaaggatgagttcatgtcctttgcagggacatggatgaagctggaaaccatcattctcaggaaaccatcagctacgtgttctctgggtctctcagagaaagacccacaagaacagaaaaccaaacactgcatgttctcactcaaatgggagttgaacaatgagaacacatggacacagggaggggaacatcacacactggggcctgtctgagggtagggggctaggggagggatagcattaggagaaatacctaatgtagatgatgagttgatgggtgcagcaaaccaccatggcacatgtatacctatgtaacaaacctgcatgttctgcacgtgtatcccagagtttaaagtataataatgataataataataaattggatttgtaagtgtgcctttaacaagtactgaggttaggaattttaaaaaggaaatgaggccactctcggaagatcccctcagtttagcagaacagctagatcaatttttagaaccaaatttttatacttgggctgagataattcaatcatgaatattctgtttactgggaaaaagacgggaataattagaagggcagccataatcatttgggagagacagcagcatcctcctgggtaaggagtcctgccagctaagcagaaattcccaaatgcagatcctggatgggataataatgaccccagggatcgggtccaaatgcaagaccatagggagctaataattagagggattatgcagtccactcataggacacaaaacgtccccaaagcattcaagatccaacaacaagaagaggagactccctctgcatttctgcagaggctcagggatcaagtgaaaaaatattcaggattaaatccagaggacccagtagggcaaggccttttaaaggttaattttgtaactaaaagctgatgtaatattactaagaaactgcaaaagattaacggatggaataaaaaaccaattaaggaaatactgagggaagctcagaaagtttgtgtgtgtgtgtgagagaaagagagagagagagagttaagctgctatacctgaaggaagagagagccagcggcacagctgtgtgtggcagctggcttctaaaagctgttgataaaggttactgctgagtcatttccgcagagctgcctgtttttgcagacagacaaggggagccagggcacagcacggctcggctcatgcccagagaaagaggaagaagctgagtgtgagacagaaaggaaatgggatggcagagagagaatagaagaggaaaattagcaagagagactaaaagagacagagatcaaagagaaacacagaaggtaaaactggggagacaaataatgtaaaaggaaaaaagagtacaagacaaagtgagagaatgctgagaggttggcagggctgggggaagtttctggggacttaagcaacaaggaggtgcaggggaagggtgcatgcagtgcgtggccactgaggaacgacaaaacccgggaactgggggatggatgcaagtgagaaagggatgtggaggagagtttaggatcaggctgcctgaggtgtaatgggttgcctacagcaaaaactagatggctgtttatcaggaggtggtcaaaaggattcaagttatggaagagtaaatgaataagataacattaaggttttgttgttgttttagtgagaggctggaaggccaccaggggcagttagctgtcagtaaggcagcagaagggctggggtcgctacataaggaaaatcagtactagggctgtaaactcaaatgactacagggccagcaaataataaaaaggagggctgcagggctgggtgggaactgtggcggctgctcagctcttcttacagtgctggcactgtgttttcagattgtctgctttgtcagaggacaaaattctgactttttatgtaaaatataattttaaaatgctgatattctgttcaaataacttaaaaacccaaaacaggcaaaagaggatgccagtttgcaatccctgaagtagagagagctcgtgctggggaaaagtctgccaaaatgctttaaggtggaatgtgtaaaagttctgtttcccagagtcgggctgggccaggggaggatccttgcagcccaggaggaggaaaagccactaagtcccctcccagggctggacaaactggagaccctttacagttgctgggtcaccagtgggggttgcttgaaacacaaacagtgcacctctaggcctgccacggagaggaacggtgcctttgaagcacaaaaaaaaaaaaaaaacaggaagggagggcggagccagaaatgccttttctaatgagagtacccatcagggaaggctccataggctggcagatcttcaaaccagcagctcttggcccaaagccaaacccagcagggcccggccaagggcactctgggatgccagctgatcagtcccttgcctccccaagacctcctggggtcaatgggccctcgggaggtgactaaactaacaccagccagtttcttatgaaaaggagaggagaataagaaggcgtcagagtataactgtttagatatcacagagtatcaaactaaagttagtaccaaaccttaaaggaactctactacataatgggatgaggttgtttatgaatgggtcatcctgagtaataaatggtaaaagacacaatggctgtgctgtcatgaacaaaaacaaacaatccttatgtgaaaaagttaaattactcaataactggtcagcccaaacctgtaaattttatgcttttaaccaaaccctaaagctcctagaagatcaagaagacactatatatactaattccaaatatgcctataaagtagtacacacctttgaaaaaatctggacagagcagggcctagaaaatagcagggcaaaataattggtacatggggaacaagttttagaaagcctcctgtttccagcagagacagccatagttcatgtaaatggccatcagaaaagaaacactatagaagctgtagggaacaggcttgtggataaggctgctaagcaagtctccctggaggaaaaatttaaactgtttagcccagatatccctaaggtgatattaaaaccccaattttcaaaagaggaggaaaagctaggcaagataggagccacttaaactaagaatggaaggtgagtgctccctgatgggagagaaataataaacaaacccataataaaaaatctaatgttggccgggtgcggtggctcatgcctgtaatcccagcactttgggaggcggaggcgggtagatcacaaggtcaggagatcaaaaccatcctggctaacacagtgaaaccctgtctctactaaaaatacaaaaaagtagccggggcgtggttgtgggtgcctgtagttccagctactcgggaggctgaggcaggagaatggcatgaacccaagaggtggagcttgcagtgagccgagatcgtgccactgcactccagcctgggtgacagagcgagattctgtctaaaaaaagaaaaaaaaaatctaatgtctatattgcataagggaagtcattggggtccccaggacatgtgtgatgaaatactaaagaattatgggtgtatagaaatgtatgccctggctaaacaagtgtgtgggaattgtgtgaactcccaggaaacaacttaaggttaaaagaacttgtaacacaaaccccaccccttgagttcacagttcaccacttccagcctggcaactcagtgctaattaagacttggaaagaagacaagctccacccaagctgggaaggtccttatcaagtgaggcagctgtacaaacagctgatcaggggtggacacattacactcgggtcaagaaactggttaaaaaaaaaaacggaaggtaaattggaagtgtatagatcacctaagaaaccctttaagctaattctaaggaaaacctaaaagtaagccataagcaggctccatcactgggggctgatatggttagaattaatcctaacacaaggggtgaaaggaaacctaagtattgtataagaaccacacgccacctaactgtaaaaatttaaagtgcaatcctatattaattactataaacaacccagctactctaaaccagaaatcttgaaggtataaattaaaaataaatatctcagaaaggaatcccgtgggacggttagcttttaggttagtcaccaactctaccccaagcccacccagaattactagaactcctggtcccattaacttcctttaacccaccaaacaataaacctaagagagtaaaaataattaaagtaactgacttaaggcagactttaaaaattaaaacaggatatagagacataaatgcctgtgttaaatgggtgaaattttcagcacaagccctcgataaaagtaactgttatgcatgtgctgctggtcaacctcaggcacaggtggttccatttccccttggaggggatactaatcccaaaggaatgtgttgcgtgttggctgtataccaagacaaggttgcatggggaaataagacttgtaaaagtctgtcattgctctttcccactttgcagagatcagatcctaaagcaatcccctcattctctatagggaatataaatcactcctgttgtcactctagacagaaggtgaggttcgataaacctgtgggaaaactcgcaacctgcacccacatcctaaatgtcactggtaacccagactgtggcaaccattcaactctccatataccccaggcaaatgtctggtggtatttcgggaaagggaacctccgtaacttgttaccgtccaattggaccgggacttgtgctttagtacaattggccattccgttcaccctgtcattccatgaaacagctaaaaatacacatggtcatagagatcagagtaatttagcaatttattttaacccatatataatgtgtgtgtgtatatatatatacacacacacacacacaaacatatacatatacatatatatacacacacatatatatatacacacacacacacacatatatatatatacacacacacatacacacaaggcttctggaacagtggatgaaagctttgtatatctatctatccatctatctatctatttatctatctaaactccataggagtacctagaggagtgcctaataaatttaaagcacgaaaccaaatacctgctagatttgagtcagcacttttctggtggtcaactattaacaagaatgtaaattagattaattacatgtcttataatcagcaaagattcatcaattacacgcaaaatgcccttaagggagtagccagacaactaaatgccactagctaaatggcttgggaaaacagaattacactggacataatattagcagagaaaggtgatatatgtgatatgctgggtggaaaatgtgacacttccattcacaacaatgctgccccaaatggaaccatcataaagggatggcagggactaacaactctagtcaacgagctggcagaaaacacaggagtaaatgacctttttactaactggttagaaggttggtttgaaaaatggaaaggaatggtaccttcaattcttacatctctcgtgattatggctggggtcttaacagccataggatgttgtatcataccttgtgtgaagggtttatttaacacaaaggttaattaaagcagctattagtaaacaaatgcccctaatgtcccaacagaatgacttactattattaaaagccaaactaaacttctcctcctataatgaagaaagtaaaaaacttccagaacagttaataaacaaagatatgtaagtgaaaataagaccaaaaagggtaaaaagaaaaagaggaggtaagtgtaaaaaataacttacatgtgaagaaggttcattttcataagtgccttagaatatgtttaagcaggccacatggaaacaaagagataaagaagcaaaatatactaagccacaatcccctccttcctgctttccctttgacccagtgtccaggagcctactggtcagggccccctcaatgacccccctccccacctcaccaaagaatttagtttgggctagcttgccatcacctaagtgcagtcactaaggccgtaagtcaaatgctcagagtcttgagacagttgccatgtattatgggtggctgcaacaaaatgcagcaaaaaatgcagcaaaaagaccctaaagaacatacctgaagtcttaatacaactaccaataggtgatgcccaggaagactataaccccgtagtactcagctaatgaggaattggggaagggacttgcacactagggaagaaatagtttgttgaaactgtcccaggtgtacctgcactccagacacctgatcttgcaagactgtcattaaaagtctctctttcgctgttctctgggtctctgagtctattctttgggtttgaatgggtgagtttctttctcacagggatgtagatggcaacgtggctctcattcccctcccaaataccccaactttcatcgcctgttccagaagccttgtcacctacaagcctatctgcacagaaggtatgaggggaccctacagcccagacagggaccctcccatctctagcaactgtccccttttctcacctggaccctctgcacctgatgttgtcttcttcttgcatcaaaggacacagagaataataatactactaataatactaatgatgatgaaagcagcaacagcagcaacatatggaatggctggtcatcaactctgaagcaccagggccatccctgaaaaaaagggcctattacacactgggcacccacagccacagccgttcctgctgcccccaccctggcctgatcctccttatgttggaaccctcaagggtggtcccaggttcactagaggacacagggtgagtgctgtgattcctgctgtatcccatggagcagatgaccctctgctcctctccttggggaatcctgcaggccacctctgtgtggtaggtcccatcccattggacagaacaccccaagactgctgggcatcctggctcaaagacgccccatcctgtcaccaggtcagagagatattctggagatacaagccagagcccagcatatcagggtgatgttgccctccagggcctcactgcaggccacactcatggtggaggagtgggggactggagaagaaagggcagagacaatgaggcacatggccaaaccctgctcccctctaatggagatgcagggaatagggctggtccgctccactgctccgactctggcagaagtcctcacggaccccagaccttctgcaagtctgtcctcaccctggggaccaattcctcaaggctggcagaaggatgggcctcgagactgtgtctttatgctctgggatccctgcattgatgctgaggaggggaatgtcagggctgggctcctggtacatggggccagagggaactcttagggatgggcaggctgggaagcagatggggcagccttggccctgggggcttcctctcctgcctgacacccacccaggttcaggcttctgtcagagggcccactgcttccccagattgtgacactggacccttcaatccctgacccactgtctttttccagtggctctaacaggagagaaaaatcaggatataacacaccaacagaaaacacatgcatccatagcacaaggagggtttccctggacagagttgggggtcggggtgactctagtggaataggggagaggaaagcccctacccaggcccagtacctgctctcctgacacccacacaggattccagatactgctgtagtttctgcctgcagtctacccatatagggtgagagtgtgtctcggccggcatagcatcttccttctagaaatttgtgatgttcatagcaaaggtctgagttctggaggactgggatactgtccattcctgagtctccaggttgagagagaggaagagctacccataagagtaggaaagcctagagcccctggtgctgctggcttcctgatctcacaacccctaatctcctggagggaatgcaaggctacccccacccagcagttccaagtgaggaactcagaccagaggagacccctccctggccctcctccatgcctttctgtgtgggctgagtgccaggttacctccccaccgagctctgctgacccctattcctcacccctgcccccagccagatccagtggggacagacaggtccctgctctctgcccccagctctcctggaaaaggtctcccatcactcttgcctgctgccacctctcacctcccttctgtcccttgatatatgccagggcccttctgaggtcctgcccattctctgtcaagtcctcagtctctgtgtcccaggtctcagctcccagaactgcttctgcccactgtccccgggacccagccctgcctttctgcctgttgaagagcaggaagggctgaccatccagatgtccctcagcaagaaaccctgactgcacagatccatcccgggacagcaccgtgaggttgtaatgaagactgtggggccctggggaacaagaaaccacggatgaaacttcttcctggaagtaacttcacattgatgtttaacacacaggtctgctgtctcaacctttctgaggaggcaggaaatgtacatatgcaaagggacaagaatgaggatttcagatacaaggaaaactgggagggcaggaggatggaggagcagactgaggaacagaagaagggggaatggagatggcaaacatgtaggccagctgccaaggcagggtggctacaggccacctaagggtatagggaggaggccaaggagagaggctgccctgcagtggtgagggaggagcacgaaggcagtggtggaaggaaggtcttgccagaggggagggtggaaatgggaagggacccaggctcagagggacccatgaccagcatggctgtgctacacaggtgagggtgagatggagtcgcgggccgctgcctttgaggaaggctcatcatgtacaagatgggagtaagggaggatcagtgcatcttttccagaaacagtgccaggaaaacgacattcacatgcaaaaagaaatgaagttggactcctgacttacaccacatatacaagttaactctaaataaatcaaagacctacactcaggaactaaaactgaaaaattcttagaatgaaacattgggaataatcttcatgacataggttttgacaacacttttatggatataacaccaaagcacagacaacaaagaaaaaattgataagttggacccatcaaaataaaaaaaattgagcattaaaaaacacaatctgcagagtgaaaaagcaaccattagaatggaagaaaatatttgcaaatcatttatctaataaaagattaatatccagaatacataaagaattcctgtaacacaaacataagactcaaaaaaactatgtaggcaaagaatttgaatagccaattctccgaagaagacatacaaatggccaatagacacatgaaaagatgctcaacatctgtagttattagggaaatgcaaatcaaaactgcaatgggctactacttcacaccaattaggatggctataatcaaatacacacacacacacacacgcacacacagagagagagagagagagagagagagaaagcaagtttggcaaagaggtagagaaactggaacatttgtgtagtacattgggaaagacaaagtggggcacctgctatggaaatcagtgtgttgcttcctccaaaaactaaaaaattaattactatgtaatccagaaattctacatctgggtatttacccaaaagaaatgaaagcaggaacattaaaaagatatttgaacactcatgttcatagcagcataattcccaataaccaaattcatagagacagaaagtagaaccagtggttccaggggccagggggaaggaggaatggggagctactgtttagtaggcacagagtttcaggatgcacaaaaatgtgaatgtacttaatgccactgaactgtacacttttaaatggtgaaaatagtgaactttatatgtatattttacaacaattaaacaacaaaaaagaaattgtcaccgcgtaccaaacaataatatagaattagaaagaggctggggtcctggtcagagagaaaaaaaccaaggcctgaggaagggccttcagagaggagtggtgctgaaggcggagcagtcacactccaaaagagggctcaggttagaaaaccctcacaggaggaaggtggtgctgggagaaggcccagaggaggggatgaccacagcccactatgtggtaagtgaagattttggatatgaagtctaggaactgacagcccaccggggtcaaggaaccgaaagaggatgagggtcaaggagccgttggactagagcctgttttgggtctgggtgggggtgaggagatgggcagggcaaggactaaagggtggcatgagaaggaagtgggggtgaccctgggagaacttggggtaaagtgagaacaggaagggaggggttgtctgggggagggtggggtttggggaaggtgagaacttgctgagggccgaaggcagctggtcaagaggtgggaacagcataaggtcccaaggcagagaggggcagagggaccagggagggatggtccagcacctgagggtttcagggtggggtcctcaagagggtgaggctgaggatgaaggagtggggaacgggtcacctgaggcagggcccagagcaggcatctgcactggaggggagggggcatctgcgctgccctgcgccctgcctaaggcccaactttcattagcaccagggctccccttaagtggcctggaggggagtgggatggagggaagactcccccgacaaaaggcagcaccagaaagttagggtcagggacagctgggaatggagaggcataggggcagcactgggtgaaggctgcttgtaggaaaggcccataagggaggcaggagggacgggagcaggggatgagggcagaggacaccctacaaatggatcagagaactgcagatagaaaggggtagcagggagcagggagggcaacaggacccagggggccatgagaaaggaagctgaggaagtaggagggaacttggtgtccttagatcattggagtccacagtagctgggagggttgacagagaggaaagaaccctgggaacgggaggcgaagggataatgagctggggatgggagcagtcgcaggaagaatcctctgcctggagccggcaggctccaacccctcagcttgagagtcaggagccccatagtccccacagcaataggaagcaccagctcctggtcccgaaaaaaggagggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaagggctggtttgtccgaaaagtgagaggaggcggaggagaggtgaggagagcaagtgcaagaagagaccagaaagtgcagggggtgggggtgatgcgcgatcccgaggaggactgaaaagagactgaaaagcagggctgaggagtggcggcaaccggcagcgtccagctcccgcacctcgctgcacatcgcacctgagccccgccgcgaccgcatcgcgctcgctgcgacccattcagaccccccagaaacgccaagccgctcccgctctagccgagggctagaacaatcctgccacctcagcctcctgagtagttgggactacaagcgagtgccaccacgtccagctgtcatttaccatctggtaccaacccccattagacaatgaaccatccatgatcacgaactgtgtcccttccatcttcgtcagctttaggagcattttttttcccaatggaactccacctatgattactaaccattccccaggacccctagcctacacttttctgtagatgaaaatgtcatacaccacagagttttaacaattacttagttttcccatccacattcactgattatttatttcgagcattatcatttattgagcacagcagggactggggtcttgtccccaccttagagggattatttacactgctaaaggtcacaagggtagtgaggggcagagagggagatggacccagctctcctgacgctggtcccaagctcttccctccacagtgtctaccctctctcgaggactttttctccctgcggcagttccagcaaaggatctcattcagctcacccccaagaagacttttaatacttcaatgacgatgatactaataataatatgcaaagtttgttccaacgcatttagaggtgatcgcgacaagacatgaagccaatccctccctttctggggcaggggaggcagtgatgatcttggactttggatgagtcgctccccagggtctaggcctggctgcccctccccaaccaaatctcccaggtcttttctgtccaaagccctccccctctaccctacctccagctccttctgctctgagccatcaactacgttttctccctcagcactcgccttagattcctggacttaccagcacaaaggtgattttctcctcgcagactgtaggcgccactgctgggtccggaaaagaaagagaaaaggcccagcgtggtcgcgtgtgtaactcaggacgcggctgcgctgggcgcccgagcgcgttctcaggactgcggcccggagttcactgcgaggactgggatcacccatcaccccgccctggtctacggaaaatgacaagtgtttactgatatagaaacggaataacggcgctgtgggctggggagggccgagctgccttcagggttctggtctccagctgcgcggcactcacacctgccgctgtgaaaatgcagacccacggggcaggaattccgagtcccggctggagcgcgatctggaatctgactcgcttgaaacagcaccgcggtggattcggagccgggtgagcagggaactgcgcctcagcccctcccacgggccgcccactgattccaggatccgaaaacgcttccagctgctccgtcaccccaggaaggcagcgccggcctctgggcggttctggtggaaacgggctccgccgcccgcaggaaaactcacaactaagggaccaggaaaaagcctctcagggtcgcgcgccttcagtgaggatcctaatttacaccccgagtgtggccccgtcaaagactagagcgaaggtcactgaaatgacacaagatcagcgaggcccagggcgctgccgctcacagaatgcggagacacggctgcctcgcgtcccttccctgacctgccccaggcggacgcggtgacgtgtgtttgcctcgaggctggaatacatggggatcaaatgcagagaatggagaaaggagggaaggatggggggacatttcgaggaaaggaagggagagggagaaaaggggagagaaaaggtgaaggtgagaataatatctgaaagatgtagttttattatttctaattttatttttgccctttatctagttttgttatttatgaacatttttaccaaagcttttttttctctgtgtgtgaatctgtaaatatacggcttattattcttatttcagagcctgcgaggtcaagctgcagagaacatgagcttctacctccagatgtgccagggtgcatctcgtgggtgcaagaacaagggttttgttttgttttacaaaatcaaagtacaaatctcaaatagaataatatttttaaaccattattgggacatactttgcacacaatcagtgtatctatttgaaatgcacagctcattgagttgtactgcttggctgttttacacacccacatatccactaccacaatgaagataaagaaataacatttccatagtcccctaaagaatagccacgcgataaaattccacgcagtccttaaaaagaggaggataaatttgtaagtattgttatgagaagatctgtgcccagcctacttttatccatttttaaaaggacgaggatatatggaattataataccagtaataccacttacataatatatattttaagtaggggaaaacatggaggattattccccaaaattttgacagggaccccagggactgggataacgttgtgactttcaccttctctgaaatgttggaattttatattacagaataaacttggattttggccaggcgcggtggctcaggcctgtaatcccagctctggaagctgaaggatagcttgagcccaggagttcgaggctgcagtgagctatgatctcaccactacactccagcctgggtgacagcaagagatcttgtctcagaaataaataaataaaatttaaaaataaaaataataaacttggatttgtgtggtggttaagaaaaaatatttgtttgaaaatattataaagataagccacacacccaaatagttacaggattttaaaaaccaaagtgttaattaaaacccaactccagaaactctcttttaagggggcttcatattttcatgtcattaaatctttctcaaagtatctttgatagagccgtttttagtgcagtagagagatgtgtaacaattttacaaaaggggcgggctgtaataaaaagggaaaggcaaaatccagtgtggacacactgtcccatttattttcaaagcacgtttgaaaactgcgctgctatagcgtctttgggttgagacaaagtcgaggaaaatcttgttcctggagtactgatttcctttttcccagggccaaagtctaaaactcagaagcaagtctaaaaactcaggctgactttcagatctgaagaaatctcaagaatatttgtgtggaagaacattccatgctaatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgttacctgacttcaaactatactacaaggctacaataaccaaaagagcatggtactggtaccaaaacagagatatagatcagtggaacagaacagagccctcagaaataacaccacatatctacaactatctgatctttgacaaacctgagaaaaacaagcaatggggaaaggattccctatttaataaatggtgctgggaaaactggctatccctatgtagaaagctgaaactggatcccttccttacatgttatacaaaaattaattcaagatggattaaagacttaaacgtcagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagggtgaacaggcaacctacaacatgggagaaaatttttgcaatctactcatctgacaaagggctaatatccagaatctacaatgaactccaacaaatgtacaagaaaaaaacaaacaaccccatcaaaaagtgggcaaaggatatgaacagacgcttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagctcaacccttgtggaagtcaatgtggtgattcctcagggatctaggactagaaataccatttgacccagccatcccattactgggtatatacccaaaggactataaatcatgctgctataaagacacatgcacacgtatgtttattgcggcactattcacaatagcaaagacttgaaaccaacccaaatgtccaacaatgatagactggattaagaaaatgtggcacatatacaccatggaatactatgcagccataaaaaatgatgagttcacgtcctttgtaggaacatggatgaaattggaaatcatcattctcagtaaactatcgcaaggacaaaaaaccaaacaccacatgttctcactcatagatgggaactgaacaatgagaacacatggacacaggaaggggaacatcacactctggggcctgttgtggggtggggggagaggggagggatagcattaggagatatacctaatgctagatgacgagttaatggatgcagcacaccatcatggcacctgtatacatatgtaactaacctgcacattgtgcacatgtaccctaaaacttaaagtataataataataataataataataataataataataataataataaagaccaaaaaaaaaaaagaatgtttgtgcggacagctacgctctaagaatccagctctcttgggctccaagctcaagctctctggggcttcacccagtgacaatggccggaaggacaggacacagtgaaatggcaccagtgagtcagaggccaaaggaggatttctggccccagcgcgcaggatgtgctttgttatagtggggttgggatagcggagcggaggcaaggacactctgggaataaatggcgagaaaaagtgcgctagggaggatccaaagccttcagacttcttcctttccttcctgttgggtgggaggggaccaacatggtccctggtggggaggtccgtgggatgcagagaatggggtcgctgcaaaggggcgttgcgcgccccacgcaaggcttctggcactcttctcctagctactactgatgagttcaaactagcaggagactaagacgtgtcctttgcaatgtagactccatatcttgcacttcggctggtttactaaatccatcttaataaaacacaaaaacaaagaaccaaattctgcgtgtgatatttctgacctctagaaggtcctccctctccccattcctcgtgggctcccttcttgccccgccccctccgctttgtctccacttctccatccctgtccatctctggaccccgctcctgagtatctccccccttcttcagaggacttcccctcatggagtacagactcctccacctccaggaaaaagagacaaagtccactgagaaggaactgagagactcctgttactccacccctgaagtcagcctgtcccacaacgctcactcaggctgcatgtgtgtgtgtgtgtgcctgtgtgtgtgtgcccgtgtgtgtgaatctgtgtgtgagagtgtgtctaaatatgtgtgtgaatgtgtgtgcgactgtgtgtgcctgtgtgtatcagttagcgtgtgtatctgtatatgagagagagtgtgtgtgtatgtgtgtgtgtgtgtgcgtgaatgagagtcaaagtgctaaacctggcatccaggaaacctccccaccttggcactgcacgcaggagtcagtgttatgtgcacctgtgcttttatttcaggagctgagacaattgtattaatcagatgtgcagagagccaagggccccacgctggaaagcatcagagaggagggtgagattggaggagcccctgactcc

SEQ ID NO: 553 - DNA, 37523 bp, Homo sapiens
gatttcacaaggaaactttggaaaaggtaaagaaagaagagagaaagtaaactaggccctggggccttcctccaggcaaagaggcaaccaggcacttggcaggaaatacccctggacggagatgagacctgcagccccagggaatggaaggaggaaagagaatctggtgagtaggtgggatgcagccaacgtcaaatagtcatttttccacgtatccagatgagggagatggcgtcaattactctaagtcatgagatcggaagggcacaggataattggctggaaaaatgctcctttgggtgcatatttctgtaacaaagaaaaacacatttatgagcatttgttttgtttgtttgaggcagggtctcactcagtcacccaggctggagtgcagtggcacgatcatggctcacagcagcctcaaactcctgggctcaagcaatcctcctgcctcagccttcccagtagctggggctacaggtgcacaccaccatgcctggctaagttttgtatttttggtaaagacaaggtctcactatcttgaccaggctggttttgaattcctgggctaaaaggattctcccacctcagcctctcaaagtgcttggattacacgtgtgagccaccatgcctagccatgagcatttcactgaagatagaaggaagagaaatcctacgaagtgtttttcagggaagggatgaaaatggaaaatcctagcaaatgctcattactactcatgtaaatgtgtgcaaaatgccactggaattttctttccttttttccgttgtgaaatatttcaaacatatagaaaaagacaaggagtaatataacaaaagccttgtacctaccaccagaaatagcaagtgctaccattttgccacatttatgtcagatcattttttaaaagaaatgagacagcccaggcacagtggctcatgcctgtaatcctagcaccttgggaggccgaggtgggaggattgcttgagcctaggagtttaagaccaacctgggcagcatagcaagaccccatctctacaaaaaacaaaaaattaatggggtatggttgttcgtgcctgtttcagctactcaggaggctgaagtggaaggactgcttgagactgggaagttgaggctgcagtgagccatgatcacgctgctacactccagcctaggcaacaaagtgagaccctgtcaaaaaaaaaaaggaaaagaggaaagaagaaatagagaaagagagaagaaaggagaaagaaagaaagaaagtaagaaagaaagaaaaaaggaagaaaaagaggaagaaaggaagaaaaaaagaaaaaaggaagaaaaagaagaagaaaggaagaaaaaaagaaagaaagaaagaaaaaagaaagaaggaaggaaggaagagagagagagaaagaaagaaaaaaccttacagacacagttgaagtctttgtgccccttttccttcctccaactgtcctgaagttggtaggtattctcacactggtgctcatactttaccatatatgtattactcgtaaattacacctagcattgctttgagtgcttcttaatttatgtaagtgatgtcacactaaacccaccattctggaacctacttttttttcagctaaattgtgtttccaagatcggtccatgttgatgcatgatacattcatttttactgctgaataacatgaaactgtacaaagataccacaatccatccactcacctactaatagacatttgtttccagtttttcaccatcacaaatgattctgcagtggacatccttgaacatgcttctgtagagtagacccctacaagtggtgttgctgggccgcagggaagatgcgttccagttattagacatgctgtcaatttactcgctagcttggctgagccagttcacgcttgtgccagcagcagacaaaacaactgaaaatgttatttattcagtgtgctcttggattgggctctcttctgaatgcaaaaccaattataaggattttctctagttcgttcccgacctttgttctccaattctactttcccttaaagtcttaaattctttagccataaattcttctacaactagggttttccagaatctgacctagtggccaagaagaaatgactggtatgtgtgttacaggatggagtcgggtatgtgtgtgtatgtgtgtgtgtgtctgtgtttgtagctttgtaccaaagccaacaagaaagaactggaaggacaagactttccatagcatcttttaaatgatgcatcaaacccaggaaagaggggtaaccagtgtgacccagaatccactctcaagctataggtcctttcctccccctcttatttgttgggggtcaagggggagttgtcccaggacattactctgtggctccatcttccctgctccccaaacccaccagactccagacacttctctaagctgtgtaaacctaggggtgagggaaagaggtactctgtgcagaggaggggcagccccatgtgttcatctggggtaaagggctgacttttggccccaggcctaagagctctctgtccatgccaaagattcctcctgcatctgggcctgtggggttgggagagctgccaaaatcctagactgggcagtgacagtggagagcctatatcttggccactgagccgattcctcagccccaggaccatacagaagttgtctggaattccttccctcacaggccctgaagcaggagcctccaaggcctctgaagttgacttgagaaaaggggatggggggataaggagggggatagggattcaagggaccaccacaaagttgcctagctcaaaccaaagacatttcaagaggcaggaacctgaagtgaatgaaaaagcacaattcacagttaagcgagagtagggagggccctgacccaaagactatttttgtgttttttgtttgttttttagggtttttttgagatagggtctcactctgtcacccaggctggagtgcagtggtgcaatcacagctcactgcagcctccacttccgaggctcaagcaatcctcctgcctcagcctccccatagcagggaccacaggcacacaccaccacacccggctaatttttaaatttttttgtagagaagggatcttgctatgttgcccaggctggttcaaactcctgggctcaagcaatcctcctgccttggcctcccaaagtgctgggattacaggagtgagccactactcctttctttctttccaacagaaagactatttttggatgggatttctcccccagcaaacacttgaagtgtgacctacaggagttgtttgtttggaggggggcatttgtcctttatcaaaaagatgaaacctggttgggtgtgagtttcttgcctgtaatcccagcactctgggaggctgaggcaggaggactgcttgaggccaggagtttaagaccagcctgggcaacatagggagaccctgtatcaacaacaacaaaaaattaaaaattagccaagcatggtggtgcacacctgtagtcccagctactcaggaggctgaagtgggaggatctcttgagcccaggagaacgaggctgcagtgagccatgatcacaccactgcacttcagcctgggcaagagagtgagaccgtatcccaaaaaggaaaacgataaagcatgaacatcttggcgtccttgttccacagactccttttggcccagaacagtctgccctttgggcagcaggtggcttgcttcagcctggaggccaggaggcctactcaggcgcccagggcgattcaccaagggacctcacctctgagccccgcctaccacccaatgaggacgcgcggacatgacgtcactgcatcctgttgcccagcccagaccaggagaatgggacaagctggagaaaagagccagtggaagtgccagatgccaagagagaagttgggggaaaaaatggtggagggcaaatgagtcagcagcaagtttaagcaatgaaccattgcatcacggggtgtttctcaaattcttgtctacttttagaaaaagtacgcaatgacattcagtgggcatcttgattctgaaatagctaaagaaaatgttaaaaatgcagtgggtgaagatgtgcccacattaacctcttttctaaaacaacagttgacaattgtgctacatgtccttaagcaaatcttttagcctgcctgttccttagtttcctcatctgtgacatgaggggaatgtatgaaaaatatctctggagattccttccagtctaacattctgtggtttgatgattgatactatgctcacattcttaatactcaggctgtgtctacacagtgccaagacaactagctaattcagtgagtatggacaaaatgttcttccaatcaattctttggcacgctgtagacaaattggcacttcttttcattttacaactggttgctccggcttcttcttgaccagtgcttcttcaatggtggtatcctgacatgctgtatgcctggagcacttaggaggtgtgtcctaggcagttggctatggataatgaactgttgaggttctcaaatcgttgatgacttttttttaatcaattagaacagattcaatatggtcctatagtaatgcccctgctgcttagttgcaatccgatatgcctccctgaaaggaagaagtggtggaattacagctgccggacagagactgcctgtagccctgaccctgttggatgcccatgggagggtgtcatgtgttgtgcatgtgaatgtcatttatcatctgcaacacagcacttgagaatgactgatggaaacccctgagacatggtcggacatcaaggcactggagactcaggccctggagaaatctgagccagcatcctatgacgcaggtgcaaaccaggaagagtacagaatggagggcctgttcattatgcctgtctcttggtccaaaatgaatgatttcaccataatctgttcatagctggggaaggaaagggggcgtgaaatagcgtttattaatcatgtaggggccaagcccagtgccagacactcgtggcaggttttagtgttgctcgccatgtactttttattctcagctgtccagggggattacacttcctccctcttgtggtttggaagagtaatgtaaaattctggccaatgggttgtgggtagaagtgacatgtaccaactgaatgccagggcatttcgctgatagttttagaccctccagagctccctctccctctagcatgggaactggcaacagtctggtggctcttccatcaccagctggaatcctggaatactaggaaaccgagctccgagaagagacatgaggcgtgtgtatcatgcattgcacgtgaggatggagtaaaactttgttgttgtaagccaccaagattttcaggctgcctataactgcagcacaacctaattttgtgctgtctgatgccatgttttatataacatggtagtgtagtagaaaaatgtgagccttagagtttaaaatgctgggcacgatgtctcacgcctgtaatcccagaattttgggaggccaaggtgggaggatggtttgagcctgggagttcgagaccagcctgggcaacatagtgagactccattttattttactttttaaaaaaataaaataacaatttaaaaaatagagattaaaagacatgagctaaaacctaaacactcactgactgtgagcaaatctgttagcttctttgagtctcagtttcttcatctataaaatggcacgatgtttttattaggttcggaaataatatttaaaaatatctagcacaggatttggcacatagtagatgctcagttacaatgattataatttcatgtattcctcaaaataatactatgagtaaagagagggtatgggtgtaagagaaaggatagtcattactgatgtttcaaatgccgtcatacactatggagaacactgaccagggaccccaagggtaggggaaggtttgaagtcatctgtgtccaccctcccctgaactcagagaagtcctagaagggagagaaggcctgaagacaccatttacaatttagcctttccactgccagaggaaaagcagattctacttatggtagtgactattgacaccttcagcatataaaataagaatatagcagtggagtgagttagtgtccctgttagtttcactgaagcttgttatcctagcaaagcgccagccaaggtctttcccaaaggcgcaatgaactaaactcttctctgaaatcagcttattagtattatcatgaccacttcagctagctcacccaggacctgggaatgagctggagagtgaactacagaggaagggagagaaagagaatatcctcaaggcagcaggggattgaggggtcctttgtctcctcctgcttcccagcaagtcttgcctgatggaggaacaagagcagtcagaggacggggtggggaaattccaattctgtgtgtccttccttcaccatgccagctgctctggaaacctccagttccaggtcagatgcctgctgcagttcccacttatatttaatttggtagagtatatctcctccaatcccagttttctccaaggtctgctcccagatcatcgtttgcctcttaaataccacatcctagccatgaacttggaattctgaacattcaatggcctgcccccttggaacgcctcaattctgcctctgggatgaaagttccttgcacgttttcacacacatggagtgcagagagtcactgaggacccaaggagaacttgaacatcaccttgaccacctgtcatcagcaggaagtcaggctggaagcacttgttgaagcccccacaacctttggtgaatgaaaaatagagatgttccattccagacaaagcactgcatgcttgggcagctgttccacctgccaccaatccaacccggatttgctcttcactgacttttcacttttccacgcagaccaagaccccatgaaaatgcccatggccagtggggtgactgatttccagcaaatgtgtggtccttctaaattggggaggtttaccagaagcatgtattagatgaacatggatttgtgacctgtgctcaggtccctgttagtttcactgaagcttgttatcctaggaaagcaccagccgaggtctttcccaaaggtgcaatgaactaaactcttctctgaaatcagcttattagtattatcatgaccacttcagctagctcacccgggacctgggaatgagctggagagtgaactacagaggaagggagagaaagagaatatcctcgaggcagcaggggattgaggggtcctttgtctcctcctgcttcccagcacagctttaaaccctgtgctcagggtttaaagcatggcgagaatggaaaccggatggtgagattgagtcctggtggggctagttgacttcattttgatcaagatcacagattttacccctgacccagattaaaatctataaaatgggcttttgtgaccatgagagacacaagcagtgacgtgcaggagcagacttatagtggcttgtgagagccaggtgtaaaatattctggagctttgtaagccaatttttaaaatcattagtagcttgaaatctatcgtggtgcaagtatttataccatggaaattggtaaacccctacaaatcggggtttctcttcctccttccctcctcctccttctttgtgagagctagtttaccaaggcatgtgtgtcttctcgcaaaaccattctttcattggaaaaactattccagatatgggatcaggggaacagttttgtatatgggaagaacatagctctctggaatcacagacagctttgaggactcaaaaaaaaaaatcaacaaccaacttttaacattgatagaaactttgattagatagggagttgtggcttcagtgactgtgctgagattttaaatttaaaagatcttgctgaagtgaaaattacatgtaaatgttgggttgtatagcactgtaggagtctgtaaaaagagctgtagtaatgttctgtaaaaagtctttattgaattctcagtagagcagtggtctgtcgttgatgtggcttccagggagggagcatctggcccccaatccttgcagagaggggctgacacccggattgctgctgactgtgcccactgctgtgggggctgctgcaggagggaaaaagagctttgaataatctgttacgagctcaaccgtgtcccctaaaattcatacattgaattcctaatcaccaatgtaactgtgtttggagataggatctttaaggaggtgattaaggttaaatgaggtggggcaccaatccaatctgactgatgtccctatcaaagaggaaatgtggacacacagagacacactggggatgagcatgcatagagaaaaggccacatgaggacacaatgagaaggttatgtctgcaagccaaagagagaggcctcaccagaaactaagtctgtgggcaccttgatcttggattctcagccccaaaactgtgaggatgtaaatttctgttgtttaagccagctcatctgtggtattctgctatggccgtcctagctggctaataccatctgcaatccagattgcttatttctgttcttatctgttgattgatcagttttacagggtaattgaccttcctccacaattcttcaggctctcctaaccctgcctgagattctcaatgtgcctagtcacccaactgtgacaccaaggggtggggccatggagactgactcagaacttggcaggttaccttagggggtgacagtcagattgaacgtgtgtagaacttagctctgccagcatttagctgcagaatcatgagcaagcctttgtcccctttatgcctcagcgtcctcatctgtaaaatggaggcaaaaatattctcccttataagattatgttgatgataaaacaagatcatggaaggataagcacgtggcacagtgctcagtgagcactctcttctgaagcgaagcaggcctggggacagcctggcttagagatggctctgcttgccctagcactgggtgggtggaggaggcatcgggggatggggagggtgcctgagagggcagggtcattcctctccaggtgacctgcactgtggggagcaggtcacctcactaggacagttcctcctgggaccaagaccttccccctgttgaatttttctccctttggttgttccctcacagaacatgctcttcatggagaatactgtgtggcttaaataagataatcaagtaaaagcttcacagagagcctggctttcagcaggcactcaatacatggtaacgatttctacatctgcagttcctaaagcagctttcacgccaccccccagggcagctgtagccacagaattgaggcataatttggacactgttggtagaaacagcattgggtaactttattaaccaatttggttcagccttattaaggaggagagctccattcatgccaaaggcttctccaagcccttcgcaaataaccaggattcaacagcctgaactcccccaagaatgactccgtgccagaacacagcacaacccagcagtgtggcccttcctgattctcccatcctccttgccacatgggctgatggaggcttaggttctgtggctttaccgagctccaactctcttcctgcacttgagcaagagcacttggtgacctggtgagatggtagaaatggacacaagccctgactcctggcaggagacttcagacttgcagcatgtgcttaaaccacaggaaacggtgtggctcacaagtggtctgagcccaggaatgatgaaccccatgatgctgggagttcatctcatcgagtcagctctgtgacatttgggccatggagctgtggacccagctctccaggaacttctgcctgcagtgactgaaagctcttttgacacttttctattttactatcccctgggatcctgctgagcacacagggaggcttcagtagaagtcactttgtgtctctgtgtcaccttctgattaaaataactttaaaagtcatgttctgggccatgcacggtggctcatgcctgtaatcccagcactttgggagattgaggtgggtggatcacctggggtcagttcaagaccagcctggccaacatgacaaaaccctgtctctactaaaaacaccaaaaaaaaattagtcagtcatggtgcgtgcacctgtaatcccagctactcaggaggctgaggcacgagaaccacttgaactctgggagtagaggttgtaatgagccgagatcgtgccactgcactccagccagggtgacagagcaagaccctatcaaaaaaaaaaaaaaaggaatcaaaaagaaaaaaaagtcatgttctggaatggcctgcttcgtaggtacaaaagagcagggtttgcagagtcaggcaaaataaagggttggcttgcaatctaaccttatcagagacctggtggctaagggacccttctgtggagatttgcgagaatgtactcagcagagaggtgaggctcagaaatgaattcaggtaaggaaaatcctctgctgattcagaaaaagggcactcacgagtttctaacattctggaaacatcacatgttactctatttactccctatttactctctttctatctgcagggcccaaagcaggatggagataaagatgcccagaagaaaccaaagccttcttgggggaaactgtaagaagtcaggagggaattctttattagaaattgaagatcccgctgggcgtggtggctcatgcctgtaatcccagcactttgggaggccgaggtggacagatcacctgaggtagaagttcgagaccagcctggccaacatagcaaaaccccatctctactaaaaatacaaaaattagccgggcgtgatggcacgcacctgtaatcccagctactcaggaagctaaggcaggagaatcacttgaacttgggaggtggaggttgtagtgagccaagatggcgccattgcactccagcctaggcaacaagagcgagactccatctcaaaaaaaaaaaagaaaaagaaaagaaaagaaaaaaaaagaaagaaagaagttgaagatcaaagctggagaccaggactcttgacaaatctgaccagatttgaaacacacctaagaaatgtaagactcaattaattctacatgagcctaagaattaaaccaaataaagaatgacaacacaagtaatgaggatactggcttatgcctaggtgtttgtatttctttaggtctaactccaactgtatatcctattttaaattaatatttgttattctttgttttttgttattttaataaaaagctctatttaaatgtatttaaataacattagccagatgtggtggctcatgcctgtaatcccagcactttgggaggctgaggcaggtggattgcttgagctcaggagtttgaggacagcctggccaacatgatggaaccacgtctctacaaaaatacaaaaattagccaggcatggtggcacacacctgtagtctcagctacttgggaggctgaggtgggaagactgcttgagcctgggaggttcaggctaccatgagccttgatcacaccactgctctcaagccaaggcaacagagtgagaccccatctcaaaacaaaacaaaaagagaacactaatgccgttagaaaagaatgctttcattactaacaccactggggagccaagcaattcaaacccgcctgactccatgtggcagcttatttcaagtacaggcaaggagactcaaaggaaataaacagtgtgtgggggttctagcgatgcaaacctataaggttcttgtaactatcataatgcttgatcaatacttattaacaaaccacattctaggaggaacaagttttaaaagcctgaaaattggacagccaacgtcctaaaggtgagtgagtagcagtgagagagagaccaaacacagtgtgtccctggggtgatgctgctgtgctttaggtgaaaatgtcagtaaatggtttagccttcacatacaaaaaagcacaccaaattctacagtagtgaaaggtggaggcattctgtgcaaagtcaagttagactccttggaggttccaagagctcagaggagacccttgggttttggagatatcctggggcaacttgtttggttaaaaaatgtagaaaaggaaacactggggacccacaaagagatgaaaaactactcttttgtggaaactttcatttctcatcaaatatccatgtacccacccacttttctgaccctcttccattagttaggggccttgtggctgatagaaaagtgactgatgctgcttctgggctgatgcatgtaggagctggcacccaacatgccaactcgggccacatgctgaggtgtcagggcgggatgtggaatagagctcctcctccaagctgacttgggcgcattgtgtaagcacgcaagaagcctgggaggtgcaaggcctctgagatttcagaggtagtttgctcctgcagtttagcctcatttgatctggtgtgtacatacttcattcctatgccaatctcagtaaccaggccaggaggtaatagaacctctgccattaacccatgtgtgagcttgaggaagtcactcttctctgggtgtcattttcctcatgtggaaatttagagttgggtcagttggcctttctgctctgtcagtctccaattttgtatttttgaaaatttccatctaatagtgtctgaaaagttgccagtactagtgtctgtctatccctgtctattatctacatagacaccgccccatccacccatctgtctatgttcatccatccatcttcccagaatccatccatccttccatccatccatcctcccatcatccatccttccatcatccatcctcccatccatccatccttccatcatccatcctcccatccatccatcctcccatccattcatcctctcattcattcatcctcctcttcatccatcttcccacccatctccatcctcccatccatccaccctcccattcattcttcctcccatccatctccatcctcccatccacccatccatcctcccatccatccatccttccatcctcctattgtccatccttccatcctcctattgtccatccttccatccttccatcctcccattcatccatccatccttccatccacccatcctcccatccattcattctttcatccatccatcttcccatccatccatccttccatccatccatcctttcatccatccatcctttcatccatccatcctcccacccattcatcctaccattcatccatcctcctattcatccatcctcccatccatctccatccttccatccatctccatcctcctatccatccatccttctatccatccatccttccatccatccacccatccccccatccatccatccatccgttcatcctctcatccacccatcctcctatccatccatcctcccatccacttatctgcccatccatctccatcttcccatccacccattgctccattttactcctgtttcattatgaagggagctgggacagctgaaatagtgtttgggactcaacaatttgcctccccttccctacatcccttactgtgatggttaattttatatcaaactggctgggccacagtaccagatagctggccaaacactattctgggtgtttctgtgagggtgttttggatgagattaacatttaagccggtgggctttgagtaaagcagattaccctccaccatgtgggtgggctccatccaattagctgaaggcctgatgacaactggcaacagcaaaacatcctcagagatacacacatgagcagaaatgcaggagcatgctctgaattccctaacataaacatagaagggcacacaccccacatgcttacaaacgaaaaattcaaggtgctgctcagaatgtgctaacacaaagcaaatgctgtcacagtacctcagcactatccctcccgcccgcactcctgctctgcccagggtcatccagtgcctcttggccagtcagcatcccctgcaccaactctgccacccccatggccccttcctgatggtgcttctgattggttgcaacatggacactcagagtttgggaagaggaagcagtgattgtgctgtgctttgcaacccctccgcctgcccccactccccaattctctctctttctctcttttttttttttttcagagaacttagcagtaaaggctaatttatgaagtccctaaagatttgaactttctgcagaactggctgcagtttccagtgggttagagtctacttggagtagagcagaagctgtgagctgtgctgccgagaggagggaaggaagaagccacagcccaggacccacacccgtccagcatccccaacagccttcctcccctacagagagctcaaagatgacaccgactgttaggtgtgggataagagggacacagggtgtgggatgagatccagaagagcaggaagggggaggggtcaggagctctgtggttggagggaccacctccgttactaacatcccagtcaaattcagaaactatccaagccctggaggctcctaaaggcgcttgctccacccttgtaccatcccagttccctcctaagtttgcaagatcaaatccagtttaaggctactccttcgattttctcatgtcatgagctgacacccactgctgggaccaaatattcatttccctccccatgaaagccaaagctctattcggtaaggataaattcacattaaaaataagaggtttacagtcaggtgtggtagctcacgcctgtaatcccagcactttgggtggccaaaacaggaggatctcttgagctcaggagttcgagaccagcctggtcaacatagtgagactccatctctacaaaaaatttaaaaattagctgagcatggtggcaagtgcctgtagtcccagctagctgggaggccgaagtaggaggatcacttgagcccaggaggtcaagtctgcagtgagccaagatcgcgccattgcacttcagcctgggcaacggaacaagatcctgtctctaaaacaaacaaagaaactagaggcttttttttaaattattttttaatttttttttttttttttttttttttttggagatggagtctcgctctgtcacccaggctgcagtgcagtggtatgatctcagttcactgcaacctctgcctcctcagttcaagcgattctcctgcttcaggctcctgtgtagctggcaagcaccaccacacccggctaatttttgtattttttagtagagatggagtttcaccatattgaccaggctggtcttgaactcctgacctcaagagatccacccttctcggcctcccaaagtgctgggattataggcgtgagccactgcacccagccatcgaagtagaggcttaattttccctgttgaaaataacagaagagccgggcacggtggctcacacctgtaatcccagcactttgggaggccaaggtgggcggattgcctgaggtcaagagttcaagaccaacatggtgaaaccccgtctctactaaaaatacaaaaaaattagccaggcatggtggcgtgcgcctgtaattccagctacttggaggctgaggcaagggaattgcttgaaccagggaggtggaggttgcagtgagctgagatcgggccactgcactccagcctggatgacaaaatgacacagcaatactctgtctaaaaaaaaaaaaaaaagaaagaaagaaagaaaagaaagtaacagaagagactctcccagcccatctcacttccttttcctagagcacttacttttggaaacctgtaatcagtagttctttctctgtctcttttaaatgtatgtaaatcttttgaaaagctaaataagcctcttgccaactttaggacccaggtatgtctttctccaaggacctgggaatcatccctttgaaaggtaatcatcaaggaacatagctccccatcttctagtctctagagaagcataggagcctaacttcagctccaacttgcaaaactaccttttgccataaagaaataagaagtttatttttcctttggataaaggcaattagcaaacacagatggccactccaataaccaggagactttagaatgaactatgtgtgacaaatagaactagtcccctgaaaactagttattgtttaacgtgagaacacgtatgtaacagattggagctgcttggctggacaaaaggtaagactcctttctgtctttgcaatctcttcgcagatcacctggcatgcgcgtcccattctggttgaatgcttgtgcaataataaaactgttttctttcttttcaacctttgtgaagaggttttctgagttgagagattttgtctgtaattatcgttccccagcaattcttgtgctctcctaaagagaggatacccaggcctttcaggaggagggaggctgaggtagcaccactggcaggggagggaaggaggaaggagagaggaggggcatgcaggccctgccaaggtcagacacagctggtatagcagagcctgggcatcatccaaaagaaacaggctcaatccatcctgtacagttccccggcttccccagcccccagcccgtcttccttcccaggctctctgccctgggttcacttgccctcctttatgcatcgaatgttaaacttcttttgttttccccttcagcagttcttgcccgctttgcatacagatgctgtgtgtaatagatgcacggtaagattccattctctacctgtccgccaagtcccctttgtttccacagtgaacctcattcatctggaccccattcatgacattttcaaaaatcactttcctaagcaaagactaaagtgtattttgctttttctgtaaaggaagatgatgtcaagtaaatttatcaacaaacttgctgggagccactcaattgacttgagatcaggaattgtttttgaacatttgatgacaactttgcatactggattgtcaaatattgattatttttctcctccaccctcactccccacagcttaaatgggaccccaggcactgccctagtcaggttgggggctagttggctacctaaggggaaggcctgaagaagcaatttggtttaagcctttgagctctaattctcaacactggctgcatttcagaatcaccagaggggctttaaagtatatatgtgaatgtgcagatcccacccccagcgtttctgtcttaattgaggcgtggtggtgcccagggcagcatctgccttgacagctcccgggtgggagtctctatcacatctgtcagtcagtgctccctgtgagttcagaagcctagaggtaaaggcctctcaactctagttgctcattacagcaccgagagagctttttaaaaatatgaatgctggcccggcgtggtggctcatgcctataatcccagcactttgggaggtcgaggtgagtggatcccttgagcctaggagttcaagactagcctggacaacatagtaaaaccccatctctacaaaaaattagctgagggtggtggcacgggaggctgaggtgggaggatcacctgagcctgggaggttggggctacagtgagccgtgatcaagctgctgtacttcagcctgggcaacagaacaagacacagtctcaaaaaaaaaaaaacccaaccaaacaaacaaaacaaattgaatgcctgtcacaaagcccagcgattctagttttattgggctggactgagacctgggcaccgggagcctctgatgcgtagccagagtgagactcactgggagaggggaaagaaccgtgacttctcagtaagactgactaagcctagtgtctgggctctgctgggtaagtgtaagcaggttgattcacctctctgagcctcaattttctcatttccaacattggagtgctgcaacccaccatgcagggttgactgcagctggtgtcttccacctgcatggcctgcgttagctctctcagtagttctccttgtcagaaagtggacatttaccattagtaattaactatgttaccaataagaattcagttcttatcaatagaaaggtgctgcttttggggatgtgaaaaagaagatgccagggcccgcctgtcctcccagtctttgacaagtgtcaggacagtggctcttttccatctctcataaaatcctgtttcaggaggctggctcttttgaatcaaattgtacttaattaaatcctccctgaaactcaggggagtttcataggaactctgcatatatttacagcctttggccaggcacggaggtttgcgcctataatctcagcactttaagaggccaaggtgagagcattgcttgagcccaggagttcaagaacacctgggcaacatagggagacccccctgtctctaccaaaaataaataaataaattaattaattaattaattaattagctaagtgtggtgacatacacatatggtcctagctattcgggaggctgagttgggaggagagacagagcatgggaggttgaagaggcagtgagctgcgatcttgccactgcactccagtctgggcaacagagagagacctcttctaaaagaaaaaccggctgggcatgatggctcacgcctgtaatcccagcactttgggaggccaaggtgagtggatcacctgaggttgggagttcgagaccagcctggccagcatggtgaagtcttgtctctactaaaaatacaaaaattagccaggcatggtggcgggtgcctgtaattccagctactcaggaggctgaggcagcagaatcacttgaacccaggaggtggaggttgcagtgagccaagatcactccattacactccagcctgggcgacaagggcaaaactccgtctcaaaaaaaaaaaaaaaaagaacccaaaaaccaaaagttctgcatgctagatcttattgtaaagaatgcatatttgtattacaaaataaatgaaaagcaagttagctcaggaactgagcctggaacttactatcagatcacatggattccagagcatctgtgtgtgtttggctaacacccctcaccccttccagcctccatttgctccactaaattttagactgcgattctgaaaagtggggttgaaaatcctgttgctgctacgaagactgtgcaattctatagctcattcctaatgtcattgtcagcaggccaaggatgcagtttcacagccctgctgggtgtgaccgaaaggctttctctaagtgtgccctttcattaaactttctgaaactgctattggctttgcactcagcgaggtgcagaaagggataaagataaaacagatacagattctgcctacctgccctcaaatagattgaggtttggaagttcagacaggtcatgcatgtaactaactctaacacgcagtagagaagaggtctggctgggagtcggggcaggcttgctagaggagggagtattttaaccatgcatcaaggaagagcggagtatgggtaacggggcaggtgatgcccttgtcctaatgtcaaggatgccaaggtccaggatgtaaggaggcaggaggcagttcccggagatcttggattatttttaggaggggtgaaatagctggtcaacaggtatgcatgttttaaggtctttactgcaccttgcccaagtgtcctccagaaaggatgctccaatgtacacttagccagatattaagatgcctggagccttggtctgaaaatgcaggaggaagaggtgcaggggctgtgaggtggagcggagtttgtcctgtcagctcaacaaatatctttcatcactgggctgtctgtgtggtgtgcagagatgaaaaatggacacattcctgccctcagggagctcaacctactgggagagatagaccacagcccaaaagtgtgggcaaacctagggctcccttgaaagttataagcaggtgttgtttgtttgttttgagaaagggtctccctctgtcgcccaggctagagtgcaatggcaagatcacagctcactgcagcctcaaagtcccagggtgaagcgatcttcccacttcagcctcccaagtagctggaaccataggctcatgccaccatacccaggtaattttcttttttttagagaccacgtctcactatattgcccaagctggtctcaaactcctgggctcaatcaatcctcccgcctcaacctcgcaaagtgctgggattgcaggtgtgagtcatccagcctggcctacgagcaggtttttgagctgaaaagagtctgtcctttctggattctccctctttgaggcacctcattcacctcagtggaattattcacagggttccaccagtaatccttgggttccctgactctccaaaaggcatctaagcttcctggcttcatattgcctgactctactccctcccacatttctttgtcccagctatttaacttcagcactggaggaatctccaaggtgcttgaagagttctgcccagcttcccgcaaggctgtgccttctcaggtcatcgagcaaggaagccatccctgagagtctcatccgagagcccttgcagtgggcatccaaggccataaatatttgcatgcctgtgaacccagctttcagaaatgatcttaaggaaataagcatgagtatttgcagagatttatctataagattatgcatgagagccttatttataaaagagaaaaatcattgaaaatgacctaaattttcattcatagagtttgactaaataatttatggcatattcacacaatgcaggagttgtaaattacatcatggaagaatatttaatgacatgaaaagaaacttaaggcatttgcaaaatactgtgtactacatgatactatttctgatagtaaaaaatatatacaaacgtagagacacaagggagagagaaaagtcatgtatcaaaaatataaaactttcatgatttcagggtagtggattaataagaaattttaattctcttttctggatgttttctatgatgttcactatttgtttaatcagaataaaagatactctatttttgaaaatgatatctcctggcacaggacaatgattcccatctgaggcacatgcgggtaggaggtgggtgctggggagctgcactgcttaggccaggagagtccccctgagctcccggctgctgggacacacttctcagccatgccctcctctgcaaagtgccatacagcaaccctggttatgcaacaagctgcctcggccctgggcaaacagatcctctgactcctcggctccattacaggccataatgggacaaccagacctcaggcccgatggttgcataaaagcaggatggatagatttttctggtcactgtgttccacccagctgagcaggcatattcagactccttccctgctgtactgcttagctcatgcgaagcaggagccttcttcaggcagccttccggactaactccactatgccgtgtgcttcaaaagcccctgctctaatccataatgaacacttgcagagtactctacttgtaataatccaaacgattctcatgacaacactataagtgggtactgtgatgcttttgtgacaaatgaagcaacggaggcagagagagcacaagcgattacccaaagtactatgcagagccaggattcaaacccaggcagtgcagccccagggtcagcccggaagacaccacgccatgcagccccctggcagataattgctatcacagccacatttgcatggtgattctgagttgtttccaaatttttgctggaagactatggattcctcgaaggcatgaattgtgactttcacttccgtgggaccatccagggcccagcagagcactgagtgcacagggccttcccaggggcttgcattctcggctctgaagcccgccttctttcctactccagctgcaggtgcaagtggtgaatcctactgagccataatcttgctgctagaggcttatctagaggtgcttatgcaagcagtctggcaaaacacctctttagggacaaacgtagagctggagacttgggacgcctcaggatgtgtcagatcacagctttctgcagggcacaaggcttcttgctgcttctccagaacatctctccaaatgcctgtgcagccctgggtacctgggcagggtccagctctacaaaggatcatggctcgagtccttccgctccaatgggaaagaccaaccaagtgagagaaagagcatgccgcccagagggggagctggttgccattgtcctcttggctgtcatttgtttcttcagggtttccaggctggcttccaaccgaggatgtaagaggctgttaccaagtccaggcagatcagcacaaacatattaacaggggttatctcagcgtggtgtgatgagggatgactttttctcatggctttgcttctctgccttttctaattttctgcaatgcacatgattatttgggcaattaaataattacagggaggggaaagtcactgttcttgctttgtcccttgcaggactctttccccacacttatatgggctgctaagctccaatgtgccctctattgcatgtggcttccaccgagctctttctgatcttcacaccagcaaactcccatctctactctgtcctttccacacccttcactgtgtactgatctgctcaaatccttgcagattataaaatgtttcactggcccgagcctgctggtccccacaaccctgatttcaaaagaagtcatcttttgtgtccttgcagagcgtgcctggattgtgtctctatccttggtcccttacctggactgtagccccagttaactgctgaataccagcagctgggtgtcctcagcaaccatgtccacatgaagcatcttagtctcacccactccttctgtgtctctacgagcagcattgagctgtagatgggaaagtgtatggaaatatgatcactttttccctagggcaaagagggttggtgttcttttcttcaaaatttattttgaatctgtcttttctgtctccccactacccctcactcatgctcctgagtcactgctgagctccagggctgtacctttctcattttggaatctctaggatctagcatagtacccagtgcacagtatgccttcaatgtatgcctcttggttcaatgaatgaatgcatgaaaaaatgggcaaataagtaagttttaataatttgtcaccttgatttttatttcttgcaatccttcctgtatttcttgcaatccttgttttattccttgcaatccttcctatatgtctctgccagttgaatcttccaaagtggtgactcgaccacgtgaatctcctctggtgactttaatggctcccactgtctgcgaaggcctttcaaaacccagctgcttgttacctttctttgcaaggattttctctctcactcctcaaagctccattctggctgacttggcctctctgtatcctttcctgcccttgttgagttgcccttttctctgtgtagccacttagctgcctgtgctgatacttgctgctggctaagcttgtcataagttcagtgtgacaccctttcccgtgatgggctgattacagtaaggtcccaatctagtggtgcctccctctattgctgggttgggtaatctcccagttactctgggtttgaccatgtgacttgctttggtcaacaggaaacaggatgttagcagagacttgaaaagtgcttgctcattggggtttgccatcttttgctgctctagggaatccagcagctgtcaccatgtaaacaagcccaggctagaccagttaccctcatcatcttagctgatagccagccagccaccacaggcatgagtcaggccatattgctggacccacagaattatgagctaaataaatagtcttgggttaagccactaagttttaggcatagtgtgttatgtatctcacaaacatataagactgtgtgtttgttgactggaggaagagatgctataaagaccaccttttaaaacttcccaaatactgccactgatgtcctgatggaggtatgaaaacatccactaaaatttgtggtttattcatttttcattattttgtttaaggaggtctatagtggaagagggagatatttggggaaattttgtatagactagctttcacgatgttagggaattattattgtgtgataatggtcttgcagttacacagaaattcttccttattttttgggaagcaccaaagtagggataaaatgtcatgatgtgtgcaatacactttaaaatgtttttgccaaaataattaatgaagcaaatatggaaaataataattattaaatctaggtgatgggtatattgtagttcactatagtattgcacacttttctgtatgtttaaatttttcatttaaaaaactttgagctagacaccaggctatgagctaggagcatagcaatgaccaaatagactcctaccaactcaaagaatgcacattctctgggaaacatgtttccattaggaagcctcgaatgcaatgtgactgtggtctccaggacctgtgtgatcctggcttttcctgttccctccgcatcatcactgcaggtgtgttttcccaagttttaaacatttaccttcccagtggccttgcgtctagaggaatccctgtatagtggtacatgaatataacacataacaaaaatcatctctatggtgtgtgttgttcctggggttcaattcagcaaattttccctgggcacccatgtgttcttggcactggaaaagtaccgggactgaaacagttgatggcccaatccctgtcctcttaaaacctaagggaggagatggaaaggggcacccaacccagactgagagacaggaattagctgcaaggggaactaggaaaagcttctttaaggatggagaggccctagtggaatggggagattcttccgggagaagcgatggatgcacagttgggcatccccacagacggactggaaagaaaaaaggcctggaggaatcaatgtgcaatgtatgtgtgttccctggttcaagggctgggaactttctctaaagggccaggtagaaaacattttaggctttctaagccaaggcaaaattgaggatattacatgggtacttatacaacaagaataaacaatttacacaattttttgttgacagaattcaaaactttatagacacagaaatgcaaatttcctgtaattttcccatgagaactattcttcttttgttttgttttgcgacagggttgcgctgatcctcccgcctcagtctccctaagtgctgagatgttgcaggaagtcagggaccccgaacagagagatcggctggagccgtggcagaggaacataaattttgaagatttcattttaatatggacacttatcagttcccaaataatacttttataattttttatgcctgtctttgctttaatctcttaatcctgttatcttcataagctaaggatgtacgtcacctcaggaccactgtgataattgtgttaactgtacagattgattgcaaaacatgtgtgtttgaacaatatgaaatcagtgcaccttgaaaaagagcagaataacagcaatttttagggaacaagggaagacaactataaggtctgactgcctgcggggtcgggcaaagggagccatatttttcttcttgcagagagcctataaatagacctgcaagtaggagagatattgctaatttcttttgctagcatggaatattaatattaacaccctgggaaaggaatgcattcctggggggaggtctataaatggccgctctgggaatgtctatcctacgcaatggagataaggactgagatacgccctggtctcctgcagtaccctcaggcttactagggtggtgaaaaactccgccctggtaaatttgtggtcagaccagttttctgctctcgaacactgttttctgttgtttaagatgtttatcaagacaatacgtgcaccgctgaacacagacccttatcagtagttctcctttttgccctttgaagcatgtgatctactccctgttttacaccccctcaccttttgaaacccttaataaaaaacttgctggtttgaggctcaggtgggcatcacagtactaccgatatgtgatgtcacccccggcggcccagctgtaaaattcctctctttgtactctctctctttatttctcagccagctgacacttatggaaaatagaaagaacctacgttgaaatattgggggcaggttcccccaatatctggtgcccaacgtgggatactgagattacaagcatgagccactgcatctggcctcttcttttgatttttttttttcaaacttttacaaatgtagaaaccattcttagcttttgggcattaccaaacccggcagtggcaggctcggttcaccaacgtcatttgcagttccccgctttatgttatgggttttgttttgttttgttttttttattgagacagagtttcactcttgttgcccaggctgtagtgcaatggtctgatcttggctcactgcaacctccacttcccaggttcaagccattctcctgcctcagcctctcaagtagctgggattacagacactcaccaccacacctggctaattttgtatttttagtagagatgaggtttcaccatgttggccaggctggtctcgaaatcctgacctcaggtgatccacccaccttggcctcccaaagtgctgggattacaggcttgagctaccacgcctggctgggttggttctcaatggagtggtttgtttttggagctgctctgcgcagtggggaccagaataggcctgggttcctagcccattgctattccttaccagctgtggattctaaggaaagtcatttaacctcgctggaccttagattcctcatccctgaagcccaagggtaaaacaaaacaaaacaaaacaaaacaaaccaacccatcatgtaaagcggggaactacaaacgatacaggtgaaacatgcctaccacaccactcacaggctatgatgacaaaaacgtggctacatctgggaccaccccccaacccccactttgtacgtaggaaatacggagttgaggatggagacccacagtatgtccagagtgtccccaaaggccacagtgcccgcctggagccctccagagagcgtgcactccctggggtgccagccagagacaacttgccctgaggcttggaactcgattctccgcgtgccagagaaggggtgggacttcagaacccccaaccccgcaatctgggtcggggagcctggcgcactgcgggccgctccctctaaccctgggcttccctggcgtccagggccgtcggggccgagtcccgattcgctcccaccccgaagccgcgccaggaccaacgagggcgcagccgtatgccccagcccgctccgcggagcccctcacagccacccccgccccgaccgcgccccgcgcggctcgaagcaccttcccaaggggctggtccttgcgccatagtcgcgccggagcctctggagggacatcaaggatttctcgctcctaccagccacccccaaatttttgggaggtacccaagggtgcgcgcgtggctcctggcgcgccgaggccctccctcgaggccccgcgaggtgcacactgcgggcccagggctagcagccgcccggcacgtcgctaccctgaggggcggggcgggagctggcgctagaaatgcgccggggcctgcggggcagttgcgcaagttgtgatcgggccgctataagaggggcgggcaggcatggagccccgtaggaatcgcagcgccagcggttgcaaggtaaggccccggcgcgctccttcctccttctctgctggtctttcttggcaggccacagggccccacacaactctggatcccggggaaactgagtcaggagggatgcagggcggatggcttagttctggactatgatagctttgtaccgagttctagccagatagaaggttaccgggagctggggagcgttggatttgctgctgggctgtgccggtgcccagaaggcaggaccttgcagaaccagccaggtccctgggagactgtcagacccaccaacctggtggcattcgcagagctgagatgcattggaaattgccttgggcacatccccaaagatcaggatgtcccaccccagtctgaaggagataaagttgggggtaggagagacgcagatgcaagtgatcagtctcagtcccagacattgccttgctctgcgggtaggaattcaggattcattttccagggaagttcctgacctctgaatgagaggggctgtgtaaggccaatgcctgggaggaaggcaaggatgagtagaggtggggggaaacaagtgtcaggaagactcaaaatcttccagagaaattgtgcagggtcttaccagatctgtcctcaaagccatgcaaattgccttctttgcaatgcatacaatgaggtgtctctgggggtcagaactggttattagggaacttctagccaggactgctaaatacgcgctgttggcccaccaggctcacctatagccttccttcagtctgggcttggtttggatttcactgtgggtgccatcgcctttacactcctgtttctatagtttaaagatagtggtgctttgggaaagtgactccttaaatacagttaggtccaagtgagacaagtggcctggctgtcatttcagaatagcagcttccaagaggtgattaatttctgttggaagggtgatctttggggaggtgggtgaagagcagagacttggtggtaccgttccaggagcacaggctctcttcctttgcagtgcagaatgacctctggcagccggagttgtgtttgttctgtaggattctgaggtgggccatgggcagctggaactggggaattttgccaatctctttcatattaggattgtctgcagaaccagatatggaggcttctagcaacgtgagtgctcctgttctaatgcccttagaaacaagaaggccacactgatcatttctctcacttaggcagggagacaaggcaagagagaaacagtggatgcttttaggttctttcccttcccaagcagttgtggacattgggctgaggggaacatttccacattggctaaaggagcgtcctcctcatattttgtacattttatacccaaaataactcttcttggtatttggggaaatattttcctccccgtccattccaggaaatggctccaagtgccaaggacagagccagggaagttgcaatgaattcctgcccgtcagccccaggcagatgccttgcacgtctgagtggcccatgcagagcgtggaggtggccgccacggaacctgggtcaatgtcccacccccgcttagatgccaccaggggcgtgggagccaaggagagaagaggggctccaggaaggtagagtccttgtgtcttgtgcatctgtgaacagcactggtatgatttaaaggaaaattgagccaaattttccggcagtcagttaccccatccccaccggggtaggagtctggcagccgcagctccattctggccagtcggcagagagccttgaaattcttctttgtccacacagttgtctcagagaaacagagaggttgtttctgcttaaaaacaacacacttggtgtctgggcccacagactcctttgcacttattccacgtgtgacagccaatgtgcctcgttgcttagcagacagcatgttaccgtctttcctgctcagtttgttagctctatggaatggaatttataatcaatgcccataccaacatttcactaatatcataggagatttagtctccatctgggtgtacattacatttgctctggggtgctccaggctggggggttgccaaggaagagaagagaaaccgcagagaagacgggagggcagggcaggggtctctgagaaggggaggggtcccagagtgcaggagcaggagccaggctcatgaaaggggccacgggcgggagtatccagggacggcagtcaagatggagcacagcttaggaagctgaagggaatcctggcccacctgggtgctagagggcacataggaagtgcaggaagcagaccaaggtccccaagagagggagacctggacgctgaagcattttctgtctttattaagacaactccgtaagaattcctgctgggccaaagtgaattctaggatgcgactttaagatgggagcaagcgaaccattgaggaggcaggttaccctagttagccaatgcagatcgagaatgggaaatctttcatttattcatgcaacagatatttaacgaagccctgccgtgttccaggcctgtgatagatgctggaacaggtacagagatacaggtgtcattaattgatcagggcaacctctccttctgagtcttgctggagcttcagatgcccctcacacagagctcgagggagcctcaacaattgatcagaagtcaggcaccatggctcacgcatataatcccagcactttgggaggccaaggcaggtggatcactggagcccaggagttccagatcagctggggcaacatggcaaaaccccatctctattaaaaaaaaaaaaagtaactggatgtgatggtacacacctgtagtcccagctacttgggaggctgagaggtgggagaattgcttgagcccgggaagtcgggggtccagtgagccttgatcacaccactgcactccagcctgagtgacagagcaagaccctgacacacacacacacacacacacacacacacacacagattagagctgaaacaggagtagaaacctatctgtatctctgatgagatcagatctttctgatgaacagaaagaatgtaacccctgtactcacaccctctctgctggttacatatgttaacacgatttctcaaatgaggcttttggttgcaaataagagaaaatcactcacgctggccctgtgtttttcaaattgtttattgtgatcaacatttgaaaaaagagccgagactctcaagagtgcattacccacggtaagggtgaattttacttcttgacacttatttctcttacatgtatctatctgtctcaaatgaaaaatatatttagaaagttgaaagctatccaagtgagtataagaaaagagtatctcaccctgaaggctaaggacagggagggccaccaggcctcacgaggacccaggaaccacaaagaaggctaggaaggagcacaggcggtgaccatactctggctcagtggctatgtgggctctggtctctctcagctgttccatgcatatgaggccaaatgtggctaccctagagcttctgagccctcaacagagatgaactggactctctgcagccccactctaaattcctaagagagaagttgattgacccaatcagggtcaggagaaggaagggaggaggaaagggaggagagaagagcctcttcgtctcttgcctaccactggccaggcaattgtagccaagggggctggagtgtaaatgcaaacatagccatcaagggttgtgtatgtgtgtgtgtgtgtctgtgtgtgtgtatgtgtgtctcttgggtaggttagatctcccaggaggtccctactaaacagacttaagcccgcaaaattttagctctccagcctcacacactccacccctctaccatattgaatcttcccaaaccaactatggctttccctaactccggagcttggcctggaatgccctgcttcccctctttcccctggggaacgcctgtccttcaggcctcagttcacacactgcctcccttgcaaagctctcctcccatccccggagtccctcttcccctttgttctttgggttctatgcttcttccctcataactcccaccaggttgtgttaaaatgagttgttcaaggtcctgtctgttccactagattctgagcaacttggagaacgaagatccaaacttcgctgcctttatttcctcctttgttcttttctcatccccaagtcccttccaacttggagttatgaagaaaggaaggaaggaagggtgggagggaagaacaggaggggatcccacaggagaatgtgtatagggagaggactcagactagctaaagcttttccctcataattaatagcaaataccatgttacctgaatttaattcacagtagcatacaaaagactcgctttgttctccccattgatgtcatcagagggctgtgggcaggcctaatcttggctcaggaggccctccagcctggatctaaagagcagcagatgggccaggctcggtggctcatgcctgtaatcccagcattttgggaggccgaggcgggtggatcacgaggtcaggagtttgagaccagcctggccaagatggtgaagcctcgtctctactaaaaatacaaaaattagccaggtgcggtggtgggcgcctgtatttccagctacccgggaggctgaggaggctgaggcaggagaatcgcttgaacccgggaggcggaggttgcagtgagccgaggtcacgccactgcactctagcctgggcaacagagcaagactccgtcaaaaaaaaaataaaaaaataaaaaaataaaaaaaataaagaggagcacacatctctgcccatcctaactcccactttgacattgaggtccccaggatggagggtctgcctccatctgccttgtcccctgcaatggtgggaaggtgatggagctcaagtctagaggccaccagcttcttagggaggtaggaggtggagggtggggtgcgggccctgcacacaactgccaagtgaggatgggggtggggtccacctgaggataagtaacagtgaggctggtgcagaggacccaggtggaggtagacagcagaatttgtggtggggtggatggcacattatataagcctctcttgctgccctgtttactgagattgtttcattatcttttttggcttttgtttttaagagatggggtcttgctgtgtcacacaggctggagtgcactgtgtgatcatacctcactgcagcctcgacatcctgggctcaggcaaacctcccaccttggcctcccaagtagctgggaccacaagcgtttgccaccacactcagctatttttatttttatttttattttttttagagatggggtcttgctgtgtcgcccaggctggtcttgaactcctgggctcaagcgatcctcctgccttggcctcccaaagccctgggattataggctgagccaccacacccagccacatttcatctgtgcagctccaggggctccacattctactcttctcatttcttctccagggtacccatggcaagggatgagggtagaagatggggcagccaggccttgattaaaggagaaggaaggcagcctgtggagagggcagcccagggagtgcagagagaagtgggccatgagggagacagcagagtgcaggctgcgtcccaaatgagcatacagcccactgtgagcccaccatcttcctagagacccctctcctctccaggagctgcttcagtagcactcagaggaaagaatgatgctgtatcaacatttcagcagctcatcttttaactctaagaaaatggcagctcctaaatgttcaaaactgctttggaaacttctggagagaggttttgcagctcaggcagacagctgatcgcggcctttcttccaccccaacccatgctctccccatgctctcctgccacagctgcagcgggcccctgggtcctacatttgcagccctttgtctctgagctcagacttccaattccaagcggcagctgggcaggctcaccagcatgtccagccagtactaggacatcagcaggagcccaaccacctctttccaaaatctctcctcatgtctctcctagtttccatctccatccttctagtcagccaggctgaaaacatttgctcctcagggtgcagaagggaaagctttgcctcccttcctggtgctcactgcccctgcgattccagcccaagccctccccggctcctcaccctggtgtcagctggaagccaccatctcctaaacccacctgtgttcttccacctctgccagggctgccctctcctccaccttcacaaactcaattcctacccattctcaggtcccttatcaaatgccatctcctccatgatgcctccctgattcccctgctggaaataatggtgataacagctaaggcattggggttggctacgtgccaggcaaggagttggcactttacatgctttatctcatttcagccacataacatcgacaggtggcattatgattcatatcatccccatctgatagccaggaaaactgagtcccagagaggttagccactttcctagggccctgtgctctgactcaagcatagctctgaggaactctagcattcatcagtttaagcaccatgactttctttgctgagtcacccaaggcatttcttcatttaaatgttcttccttggccaggcgcagtggctcaggcccaatgcggtggctcacgcctgtaatctcaacactttgggaggccgaggtgggcagataatctgaggtcaggagttcaagaccagcctggccaacatggtgaaaccccatctctactaaaaatacaaaaaaatgaggctgggcgtgatgactcacacctgtaatcccagcactttgggaggccaaggcaggtggattacatgaggtcaggagttcgagaccagcctggccaacatggtgaaatcctatctctattaaaaatacaaaaaattagccaggcatggtggcaggcacctgtaatcccagctacttgggaggctgaggcaggaaaatggcttgaacccgggaggtggaggttgcagtgagccaaggttgcaccattgcactccagcctgggcaaaaagagggaaacatcgtctaaaaaagaaaaaaaaaaaattagccaggctgggtggtgcatgcccgtaattccagctactcaggaggatgaagcaagagaattgcttgaacccaggaggcagagattacagtgagctgagatcacaacactgcactccagcctaggtaaagaacaagactccatctcaaaaataaataaataaaaataaatgttcttccttgcaatgaagttaaatatgtaaattctcaaaccagttgcttaagggcacagttttgttctttacctatatttttaacaaatattttatgtaagtagttgacaaaatcaaatactgtgtacactaccgaggcttccctgggaaagccatcagcctctgccccatcccttcccactcctgattccactttcctgtgtttccatatctttttcatgtctgtttctggcccacagtgggcgatcaatacatgttagccaccaaccatcaaacctatattgagtaattatggtatgtcaggcactatgctcaatgaaattgtattaggcttgtacaaaagtaattgtggtttttaagagtaatggcaaaaacggcagttactttcgcaccaactatttgctgccttgaattattcctcctctcctcatccctaaaccctgctcctcccagccattcttcctccccttcttgggccatggccaggccccacccaggtactaagactcaggtgaaccaaggaagacttaatgcccactcttttctgatgcccatgttggcatgtgttaagtcggttagcattaagtttggctgcatttagcagagacccaaaagaacagtgccttttaaaaggcagaggttatgtctctcacacacacccagcacaagtccaagaccagcatggcatctcagctccatcaacctcaggaaccgagctcctgcagctccctgccctgcagttgataaggtgaggtctttgtcctcctggttcaagatggtgctagaatgttggctaccatatctatagtccaggcatcagaatggagcaagggatgaaaaaggaagagatgaaggcacacgacaggttcctgagagctggcacaggacacttctgcttatatttcactggccagaacttagtcacatggtcacacctagttgggagactctgagaagtaaagtatttattctagatggccatatccctacctaagacttggagttttctatgactggggaagaacggaagacaagatattgggaaagactagcagcctctactaaaagggtgatctgtgttgatgtgcgtgtgtgtgtgatgtttgtatgagcatgtgtgttatgtgttgtgtgttggtggggcagattcttgcgagcactttggtctcagatggacctgctaccagttctctctgcagacccccataggtttctcctaaacctggcctctcctattaggcagccttactcagcggcagcttctcagctccatgttttcaaggaaccacaatttatttccagcatccactgaagcatattatcagtggtgatagagggggcttgtaaaactgtttttccacttaggtattagagggtggccattatttgagagtgactatgaccacagttaatctggtaataaattctcttgggtaggaggaaaggaaaggatgctttaaggaagcatcttgccaggagacacaaagctaacaagagtggagcctgcagctggagccgcagagcctaatcactacacccgcccatctctgctagggtttcatgacttcgtatcggggattagcagtatttaactctgttgcacaaacatttggtgtattattcaggtaacaagtagctaatagaggaagttttacttttttaagacataaatttgccttttcccaaattacttggtacatagtacttttcatgtttgaagttgagatgtgggtacaataccatagctttattccagagcagggtatttgtttccaaatgccatgttcccagcagctgcccttgactgggaattggggtgtgatttgggcttttccttaaatccttgaggagctggaggggtgggtggctcgcactcctgctttctggatctgaatcctgactctgtcatggacctgtttgactttgggcaagttgactcctattcctgagccccatatttttctcttctgtgaaattcagattaaaaaaacatggctttgatcaaacattataaataatatatagacagactgcttgtttttattgtattgccagaaatgaatcctactaatattgccatctatggacagaaaatgtattacctgtcttcatcaagacccagacgaggaagaacacgaaaagcggagattaattttactgccatctccagaaccgtcatcctaatatttacttacattttattattatttcaggctcatgcacatatacttagcatggatcattggccacaga

SEQ ID NO: 554 - DNA, 38567 bp, Homo sapiens
actctggtcaatgacaaatgtttctcaacatttgtcattgttgagacattgggtgtctaggtggagagtagttgccaagaagaggagggaggttgttcagaattgctacattgggataattgttattcatgaaacccagaactaagttcattcatcagcaactttacctagttctgggcgtagaacagtgaggcggttcctctgaatgtggagctctttaagctgggtaagctccccaatttccttaagcagtgagatcaggtctttatccctattgctgagctaaacagaagaaaacaaggagttgtcaacacattttcacattaaaaggtgctccacagaaactctcatcctcctccacgtcctctcttctaccacagctcagtcctttccatttatttacaagtgctggcggataatcaagaaacactatcagaagtagtggtttattcctgcaaaacaaaccttacttctgctcagatttacttgattctacccctacaaggctgcagcagtgaattgattttctaagaatttagataacttacttactatctgcaactttgtgagcttcccaatatctggtggcaggatttcaaaaccgttgtcacttagatagagtgcacacagggtggctgcaaattaaacagcaatatataaacagggtggcatggaacccaaccatttgaggtctgatcaatacgagggagtcagctttgattaataaccctggcttggtgaaaagcctttgacatacctagggctcccaataataacaagcaggtcaaacttacatttactggcttattgtgtagctggtgtgtccaggaaaacatctatatccaagaggactgatacaattaacaacgtgggcactagcattttggggcacagagtttcaacacattttcaaaaaagattgctatttttctcacagattacttttgattcacatttatttctccattttcatccaaagtaaaacaaagaaaactactgtgccacttttatggatacctagggcaaaaagtttctttcgagggaatacaactatgttaaaatagaccttttcctatgtaaatagcactgtgttaaaaattaatgaaaggctttctggtgatggaggctataaccacagctcatcagttccataatctgactaattattactacttgtttctacagccttaaggccaaaagtaaatgaagaaaaaggggctaaaataatggcatgaagttaacagagtaaatcctaacttcagcggaatatcagcagtcagaaatcctaacttaagcagtaatatcagtagtcagaaattaagcagaatatcagtagtcagaaatttgttcacaattactacacaatgataatatgattacaaactactgaaggctaaaattctaaagcatctgtttatcctcaaccaaaaaagctgagtataattagaggtatgttttgtttatcagtatttatttattttttagagacagagtctcgttctgtcacccagactggagtgcagtgggtcactgcagcctcaaattcctggcctcaagcaatcttcctacctcagcctcccgattagctaagattacaggcacatgctactatgcctggttaattttttaatttttgtttctagagacagggtctctctatgttgcccaggctggtcttaaactcctagcctcaagtgatctttggagctcagactccagaactgtatgttaatgtaacataataaaaacaggtgttccactgcccaagaaaatattttacagttggtttcatgtgcttgagaaagtcatagagataatgtatataaggtaaaaagtgaaattttagagaccagctcagaaaattcagattttctgaatgccacataaattactaattgaagaaatagaacactcatttaagagaagcaaactttgtctgaaatagtgcatgagttcccagaggaaaccattttttaattttcagaagcatcttcagcaagaaatttgttggcatataaaagaataaagtgtgttcacctatggccaataatttcttaatgcctgtgtactggataaataggtcaataagagtactttttaaaaggctggaaataagaatcctggctagaaaatttaagaattctgttagtgatttattaataaatatttttataaataactgattcggacttcctgggcaaatatcctgcaaagaattaataccaacatgggaggatacttttttttggcatgctatttaaaaagaaagtcaagtctcttagctaaatgtgaggcttgatctcatttaggtatataatctctctcagaatgttaatatgatgttactaagtccacttcagcccaacggtgtcacataacgatatatcaaatgcacatactgctgagctactaaggaatattcaaaaggagtctctaaagaaaaaattatctctgtccaataatttctcttggagtttaggtcctggcaaataaatttcactctgagaaggcaaagtatagtgttgaggagatttatagaactgaaagtttcttactcaggtagaagtttccagggggccgggcgcggtggctcacgcctgtaatcccaacactttgggaggccgaggtgggcggatcatgaggtcaggagttcgagaccagtctggctaacaaggtgaaaccccgtctctactaaagatacaaaaattagccaggcatggtggtgcacgcctgtagtcccagctactcgggaggctgaggtaggaggaggcagaggctgcagtgagccgagatcacgccattgcactccagcctgggggacaagagtgaaactccatcttaaaaaaaaaaaaaaaaaagaagaagtttccaggaagagaatttccgttcaagttgtaagtcaagtccagaacctcaagagctggcagagagcagaagcctcgtggcaaagtgttcagcctgttcatgctgttgcagggggacaaaaatctacatcaggacaccaaagacacatttatacagactatcaagagcacctctgtttcacaggctgaaagtgtaagagagtgccatgatcctagagtcactttatttttattttttatttttttgagatggggccttgctctgttgcccaggctggagtgcagtggcacgatcttggctcactgcagcctcgacctccatgggctcaagcaatcctcccacttcagcctcccaagtagctgggaccacaggtgcacaccatcacaccccactaatgtttgcattttttgcagagatgggtttttgccaggttgcccaagctggtctcaaactcctgagctcgagccatcctcctacctcagcctcccagaatgctgggagtataggtgtgagccgccatgcccatcctattttttttaattaaaaaaagtatttatttaatatttacattgacaaatgaagattgtacatacctatgatgtacaacatgatatttctgatatatgtatcatccatcgtggaatgccttaaatcacactatttatatatgcattgcctcatatcatatgcttgtcatttttttgtcttttgtggtgagaacgcttaaaattcactctcttagcaattttcaaatatactacatattgttattgactgcagtcaccatgatgtacaatccatctcttgaacttacttctcccgtctaactaaaatttcgtgtcctttggctaacatctccacaattcccctctccctccagcctctggtgaccattttattccctgtttcaatgaggtttacttttttacattccacatataagtgggatgatgtggtatgttgtcctatttaaactaataattttagagagcttatatattcctgaaacatttggaaatttcttagttgtcatttttctccagtggtgaaatttaatcattcttttacacaaaaactcaaaccatcacaaaatatctgtccttgtaaagaaaaacttcctgatgaatgtagtaataatatctgaaactacacacatgaagctttgtagttttcagatttttgctttatttcatttcattttttccttttaggagggaaaatcatgtttttttttttctacaactgttaaaattcaaagttatcttcaattagaatggtgatggccaggggctggagggaggggcaatggagagatgtattttagtgggtgtaggattcaggtttgcaagatgagaaagttctggagattgactgaacaacaatgtgaatacgcttaacaccattgaactgtatactacaaagacagtaatttttttttttttttgagacagagtctcgctctgtcgtccaggctggagtgcagtggtgagatctcagcttgctgcaacctccacctccccggttcaagcaattctcctgcctcagcctcctgaatagctgggactacaggcatgtgccaccatgcccggctaatttttgcatttttagtagagaaaggtttcaccatgttggccaggatggtcttgatctcttgacctcgtgatcctcctgcctcagcctcccaaagtgctgggattacaggcgtgagccactgcttggccagacagtacattttatgtgcactttatcacaacttaaaaattttttaaatcgtacaattgactcttgagcaacatgggtttgaactgcctgggtccaatgacacatggatatttttcttctgcctctgctacccctgagacaagaagaccaaccctcctcttcctcctcagcccactcaacatgaagaagaggatgaagacctttaagatgatctacttccacctgaagaacagtaaatgcactttgttttccttatgactttcctgataacattttctgttccttagctgactttattgtaagaatgcagaatagaatacatataacacacaaaatatgtgttaatcgacatttatgttttggtaaggcttccggtcaactgtaggctatttgtaattaagtttattcagagtcaaaagttatgtgtggattttcgactccatggggggtcagtgtggtgctccctcaacccatgtgttgctgaagggtcaattgtgtttgggtgggtgcgggggtgtgtggtgtgtgtgggtgtgtatctggtgttgtgtgtagtgttatgtgtgtgtgtacgggggtgttatgtgtggtgtgtggggggtgtgctgtgtgtgtggtgtgtggagggggtgtggtgtgtgtgtgatgtgtgtgggtgggcatggggtgtgtgtgttgtggtgtgtgtggagggtgtggtgtggtggtgtgtgttgtatgtgtggtgtgtgtgggggtatggatgtggtatggtgtggtatgtgtatggggtgtgtgtgggggtgtgggggtgtgtgtgtttacgcagtatgtgtgtgtggtgtgtgtgtgggtgtgtgtgcgtgtttgtgtctgtgtgtgtgtctccgatgaagtctaagggaatttttttcttttctttttttttattatactttaagttctgaggtacatgtgcacaacgtgcaggtttgttacataggtatacatgcaccatgttggtttgctgcacccatcaactcgtcatttacattaggtagttctcctaatgctatccctcccccagccccccaccccctgacaggccccggtgtgtgatgttaagggaattttttttctacactatcttttatccttttctttaagccccttatttttcttaatgccgttccctttgagcacacttaaaagccaattaaaaattaaactttaataaaagttgacagatattgaaaggtggaagggactgtgacaataaaaatcattctagtcatcgatgcttctcataacagatccagctcggtccagtcctaccaagtgggcctcaccagaaacagcagacagcagggggaaaccaaaatggaaacgtgggttccccctctcaggcagaaaacgacccagacagactacacccagcaaaactacctccacgactatctactgcaatgacagcaacaacgaacattctccatgaagtcacaaatttgtgaagcacattatggcaagtacttggcttgttgtattaccttgtaatacaggcaagatggagcttgtaattaatgctatcttgagatgaaaaaaaagcctaagagagagtaaggagcaaagatttcagaagtgactgatgaaggtgacatgtgtctggaagcaccctgtacctcatggaggtcctccctataacttgccttactgtgtgagtataattctttatgccatttgaggacagaggtatcctttagtgaaacccatcttagctcctttcccaaagaactgggaggttttttcaaactttgacaactccgtctatgtagctgtgtagttaaatacaaaaagctttacacaatcaataaagcaccaatagccccaaatgcaaacaactccaaagagaacaagaaggcaactaagatgcattcattgaaaaagaaaagtttagggctgggtgcagtggctcacgcctgtaatcccagcactttgggaggccaaggcgtgtggatcacctgaggtcaggagttcgagatcggcatgaccaacatggtaaaacggcatctctactaaaaatacaaaagtagctgggtgtggtggtatgcacctgtaatcccagctactcgggaggctgaggcaggagaatcgattgaacctaggaggtggagattgcagtgagctgagatcgtgccattgcactggagcctgggcaacaagagcaaaactctgtctaaaaaaaaaaaaaaggaaaagaaaaagaaaagtttatggctctgtcctatggtgcctcaaaccaaacagaaaaaaacctgagcttattattttcttcccaaacctgtctccatctgttctatttttcagctgtccgacacagaaacgtaggtatcattccatcccatcagttactgtctgtcaatgttaccacctgtatatttttcatataaaatccctccctgtctccactgtcactgtcctagttcacatgggacatgaagctcatgttcttactggtctcctaacctctagtttccatccctccaccctcttctccacactgatctttcataggaaaatctgaccatatctcatatccaccacttggctatgcaaatttctcaatggtcagcatgataaaattggagctcgtttatttatttacttatgtatttttgagatgcagtatcactctgtcacataggctggagtgcagtggtatgatctcagctcactgaaacctctgcctcctgggttcaaatgtctctcctgcctgagcctcctgggtagaatacctgggatcataggtgcacaccaccacacttagctaatttttgtatttttagtagagacaaggtttcgccatcttgacaaggctgttcttgaactcctggcctcagctgaccctccagcctcagcctcccaaagtgctgaggctacaggcgtgagccaccacgcctgggaggagcttgtttatttagcacagaggactttcattagcacttttgattccctgccattattataaacatttatttgtttatagttggtttcctcaactgtaatggaagctccatcagggctggatggccagtagctagaataatgcctggtacacgattgggaacttggtaaatcctcattcactgaacagcagatatccaggattccctgtctagcctgacctctgaccttacagccacctgcctcacactttatactcaacagtgccaaaaaaccgacaattcctaggccccaggcaggcagtgctgtgagtgtttaaatatgtcattcgcggctgggcgtggtggctcatgcctataaccccagcactttgggaggccgaggagtgtggatcatgaggtcaagagattgattgagaccatcctggccaacatggtaaaaccccgtctatactaaaaatacaaaagttagctgggtgtggtggtgtgcacctgtagtcccagctacttgggaggctgagacaggaaaatcgcttaaccctgagaggcagaggttgcagtgagctgcgatcgtatcactgcactccggcctggcgacaaagcaagactccgtctcaaaaataaaaataaaaataaaaaaattggcaaatatctgtccagcatctattgccactccacgtcaatcactaatttaaccagagcatttagtggctacaatttaatgagtatacgactttgcacagagactgaagcatgagtgggcagtttcatctaatagctgtgccaatgaagatggaattctgatgctgcagttccgcttggggtctatggatgtattcgtctgttctcccattgctataaaggaatgcctgaggctaggtaacttacaagaaaagaggtttaactgactcatggttctaccggctgtataagaagcatggcagctactgcttgtggggaggcctcagggagcttttactcgtggtggaaggcaatgcaggagcatgtgtattacatggcaggagaaggagagcacgaggggtcttgcaataactcactcactatcataaggacagtaccaagaggggatggtgctaaaccattcatgagagctccgcccgcagatctaatcacctcccaccaggccccacctccaacaatggggattacaattccacatgagatttggtggggacacagatccagaccatatcaatggagtctgatggagcctttagacccagaaccatggggttctcttcccagcttggccactaacctcaggggtgaccaggacccagtcccttagcccctttgaaaaggcttggcttcctctgtataaaatgaaagcactaaaacctgctttccctacctcacaaatgttaagaggatcaagtgctgcaaagcaatacacgaagacaggttatcattattattatttaccgctccccggttctgcaacctcagttgaaccaaaactcctctcttcacctttgcataaagaaagacagaggattgtcacctctcaactacagagaagaattgcaaaaatgaatgaagcagcattagggaatatattcttccctccatggcatgaaggtgctttataaactattcctatttaacacagacagaaaaaaaatcaaccatactacaacttgtctgtcagttcacgttatgcaaataagtcccttcttggtcaacagaactgagataaaattttactggacacaaaatacagtaaaaatttaacttccttattgtgccaactattagcttctcaattagctctcaaatcttcactaatgtaggccaccaaaaggacatattaaaacaataaaactttttttaaaacccaaaacacaaaaagaaatcagaaatccacttctgtgtaatgatataaatggaatccctcccctggccctacccagcacgccccttccactctctttctctccatcctttcctctccactgatactcacccaaggttcaggtgtttgagtttttgaagcctgctgatctgtgttggcagctcctcgatctggttatttaaaaatttgagcacttccaaattcttcagttctgctgtgtttggtggcaccaccatggaaacataaatgctgagtgtgaatctgggaacggaactcctagcaagggatggcagcagcacactttgtttttcttcaaagctaagaaacatataactccaaaaggaccatcgaattcacctatcggtcttacttattttttatgggtttttcataagcagtcactcacttctgagtggccgctgaaatgctccttcgtatatcattagctaagtgtttggcatagtttgtttcagacagacaatgaagagggaaacagagcaaaaaggcacaaaagagaatttctgtaccatagcagcctataaaagtgaatattacgaagcatatacacttatagctgtcatataggatcttttaagtgcaattgtttttttctttcggttttcttgcattgccaccagaagaaagacagcaacctccaaatcccttcctgggtgacatacattgaagctgtttaacccagtatctgaacagctgtcctcttaacattgcattatattagctcaattttaaataatgaaatattcaatctccctagtttctgattttggcctctggagtaatgtatcttgaacaataccacacacacatacaaacatacacacatacatacacatacacacacacacaaatgttacatcagattagcaacacatcgatatactgttattatatggaaataaaaaagtcaactcagtaacatgctatgaacactagtgtgcagatcaaaggtgaaaatcaaccactggggacctgaaaggttcctccttccctagcatatatatacttgaaaatacaaatgtaaaagccaaaggcatctttatctcaaaagtacaaactataaattggcagtagaaggactttccataggctgtaattcatctatcccatttgctattcaatcattctacaaacatttgtatgggcgataagcttggccatggttcatgtaaactctgataccaagactatccaggtaactaaaaacatgaacagggacctggagcccagtctgaaaaagtgtgatatctcatatcagtcaggtttacttcccatcccatctgcttcctccaggggtgccccaggaggccagaaaaccaacctgcttgcctgcagtcagacctaaactcagacccaagagcacttgtgatcagaaccagcacaaaggtgagtgtaaaatgccaaacatacatctaaaatatttaagcagctagccatttcaaggacaccaattgataactcctagggcaacaaaattaaaaggacaggcacattgctaattatagttttgagtaatcattttcagctttctgaaatgtctacagtatcgctgacctgatttcttttagagtgaatgcttggtgaaaggtaaaagaaatgttttcactggaagaagggactgtgaagaatacggattactctgaactagggcacatgggcagggagcagtggtctagtgagcagtccctgggtgagctcctgaagtggctgttgataaaagaacaggttttcatggggtaatctagacagctggaagttcctccagaaccctccctcttggatacctgcaggaattgaaaggaatcctacctgtacaatatggacacaaatgcacattcttaggtgcacactccatggaacacttctgtggaaatgaatggtattcaccttgtgtaagcaattatcaagaaaatcaccagggccaggagtggtgccttatgcctataatcccagcactttgggaggccgaggcaggtggattacctgaggccaggagtttgagactagcctgaccaacacggtgaaaccccgactctactcaaaatacaaaaattagccgggcatggtggcaggtgcctgtaatcccagctactcgggaggctgaggcaggagaatcacttgaacccaggaggcagaggtggcagtgagctaagatcatgccattgcactccagtctgggtgacaagagtgaaactctatctcaaaggaaaagaaaatcaccaggctgtgtcttctaggtcactggatgtcatctcctccccccagatcataaagtatatacagtgcagctgcccacagacctcatccctcccctgtccaccctccagctaccactaagccttcatctgattagtttgaagagtaataacaaaagttagtgaaatcaggagaaaacgatgatctcaaattagccacaaaccaagaataatgcagccagaattactgtcatcttcccaaagttactctgccagttgaattaaatgctcgtctaaaggtatcgcctttttgacaggatgagagattatttcactctccttgctaaatcagtccaatttaaaaccacaaattatgctaaatgtggtttagggctttgtcttgtggatgcaaacaataacctcatattcaatttacaaaacctctcccagccttttggtgagcatgtgaattttttgcttaagactccattcaagctagatgagaaaaaaaattacacagctaatattctccctaatatacagaattttttaaacccccagtcatagtgaaaatctaaagaaattaacatgcagacccatctggatgggatggtattcactctttgaaccaatacttagagaatgctgattaggtgcacagcaccatactttttacacatagcatctcaatactttggggataaagtaggagaggaatgttacttaaggaaagtaagttacaaaagatagggtatcaaagtcaataaactgaaacaggcctagtgcttggaatataaactactcccaaccaaactagttgtccagaaaaaataaccagttagcaatatgaattgtgtcatgactaaatcatatacatatgtggcaggaacaattttagctatttcaaaaaggccactgcgatatcttaccagtcaaaatattttattggaattttccaaatagctataggatgcatgagcaagaagcatttaaaacctaatagcgtgcatcagtatatttcttatcatgtctttgaaacgttcctttttcatcaatctatccagcttctgacctatgaccccagctgacctatgacatcaaagaaactgaagagcaatgtggtccttggccctacagtgctgtgtgtgcccttactcaactcataacctctctgggcctctgtaaaataagaagactggattatgaccatttccaaggtctcttccactttgttttaacattctaggattctaaaaggagatggattatgaaaatcaatgatatggctttaaataattcaacaaatggggccctcaattaggaagcttagtcatgtagaactttgcttttgacaaagaattgagtatcattttctgcctagccaaagacggttgctttaagtttgagacttcagttgctaggtttgggggaacagtcccaaaggactcagacattccctggctcctcaatgtcacattttgctctagccgcaggatcacaggactgctggggatgctctcgtcccagagcatctgctggtgttttggaaaggtgacaaggatgtggtcacatcaccccagagacaaatctcaaagtttcttctaggctctgcagcagttccacctaacacacctggcatgaccttttttccttcaagttctcctaaactgaagaacctgaatgtgattcaagagttttgtccatctgatgtgccagccctagacttggcaattcagcacccctgactcctgcagcacagtttctggaaggttccacaagcagcccaaagtgcctgaagggctcattaacttctctttggctggaagcacctccactttgctggacaggctggagaaaccacagtccatctgtgcgaaacactggcacagccccttcctgagcaacagctttactcctaaaaggacatgtatctacggccattggttatatctgcaacaggcatgagccacccggcactgcacagttgatgcacattcacaaaatcaacaatcaatcagctcaagaataggcttcccccaaccagccagcagcccgcaaactatctcccctccacacgaagaatcaaaatcaactactgttataacaatagtttcaattctgttgaattgagtaaggaaaattctgttctatgatctaaaattaataattccacaaccaacaacttaaagcattttaggagtttacacaataataattagcagggtgtgttctggggctgggctatctgatggacagccactagctatatgcagctatttgaatttaaacctagattaatcaaaaataaaatgatgaatgctattgtttggtcacagcagccacatttaaagagctcaatagccacatgtggtgtctagtggcttcactactgcatggcagggatactgaccgtttcatcaccacagaacgttctattagacagccctgctctatggcagtgggtctcaaaccacggagacatcggaatcaccagaggccttgctaaaacacagatggaggggtatcccagagtttctgatttagtagtaggtttggggtaaagcctgagaatctgaatttccagcaacttctcaggggatgctgatgttgctgttctgggaaccatattatggctcagaaaacttttaattcattggcagcatcacgattatcgatccaacacatatgtcccttaccccatgcaataatgcgatgagtataataatcaatcttatccaaatgaagacgcctactgagcctggggattgatgagaagtgaaacaaatgatactctagatagctaacacgttcaacgtgggtgccacaatcaaaccctttctagtcaacttctgcttccccacacaggattttatggtaagatcagtattgcttaagatggacaatgttccagaggagaaaagccttgaattccctagcacactgaattaagtcacttggtggcaaattcatcatgaccaagggtggccatacaaagagatgtcacctgctatactgctcagcttcaaaacactgaaccttaacggcaggatgctgggtggtagtgatggcacagacagaccggcttgggtgcagctgattagggggctttttgagcaaaagcatcttgtggcccttgaggcaaagaaacaaagctgtaaggagcgacagactctgggagcagcaggcacaatgcaaaaacataaggacaggaggtctgcttgggtgcagcccacgggagggtgagggggtcacactttggtctttagagtcatatggttaccagcaacagtcaggttctcttcagctccagaagggcagcactagaccctgcaccatgataacgcatacccacggctgccaggaagccagaagctgctccaaacacatggcactttccatccacagcacgggcatgaaatctggcggtgacctccacccaccatctccaccaaacttctggggagttgggggctgcactacacccaactgtttttgcagaagcaccaaaggatgtttttagagctagtgattcctgagctagggctggcccagagcatgaaagccaggggacaaagcctctttgaaaaaagtgaactgatgtctgaacctctgcttccagtgatggatggtgaattacagcaagggaatgaagaggaggacttagggcaggcaattgctcacagccagggctaggacagcaggtggcacaggggcatgcccgcccttgtgctgcaatggaggcaacatactgtgctgtgcccatttccaggatgcaaaaatgccacctaccctcaggccaaagggtccccaaagaaaccacatggaatgagtcacagcaaaatgaagctgagtagcattgcttctaaaaacctgacatactgctattttaaaaaaaggaggtttttgtctgttgccgtaacaaatgaaaatgcctggtcagatgttcacaatgtcgtatatttctacagctttttaaaataaagcatagaaggatagaggatggtagaggatattaaaatgagcttgtcacttagataacttagtatgttacattactacaattaagttactagaaaaaccactaaaaacctgagaatagatgaaaatgagtgagattattcattatatatacgggagagggaaggaccacttatgagaaaatggtgaaagtaaacatttccttgccccagcatttgatgaatatgatactgaaaaacaagtgcccctctttggcctgaatgaagcaagggagaaaaaaaacaaattagcagaaacgtgatgaaatatgacttggggcatccgtggtcaaagtgaaagcacaggctttttaatctctagccataataactggagaacattagtccattcacagcacaaaggtggtgtctagactaattatagacatgccaagtctttcagcaaatcatagttctcgatgccattttaatgattttacataaagaagaatcttctcactctcgcgtaggaataattaaactattcagcactttatatgcaaaaaaggtcatttgtagttatactgattaattaccttcaagtcctcctaagcactttatatgcaaaaaaaggtcatttgtagtcatagtgattaattacctttgttttctggccaaaaacacaaggtggataatgaacttattacatattaccataagagtttgaaattcgaaagtatactaatgataactggcttcacagattttacggaatttcacccaaagcagctattaaagcagtgaattacagtagttctaggttatttaaagtttatgaaacagtgaaacaaattctcatttaaaaggttctacatgttcctcaaggtaaacataaaatagcaaaatatcgaagcatctaccccaagaaaggccaacaaatattattagctttataaataacaaagttctccaaatattattagttttataaataacaaaggcaatgctactttcagttaataaacaacaagtatttactgagaacctgtgccccgaaagcacatgctcactctatgctattatgagccgcctcaggattctatagcctaagttatttagtaaacaaaaatgtccctggcttaactcactgcaacacaatggtcctactctttcagcagcaatgtgaaaatgaattgcatgaaaattagagaaaaaaggtataagcaagtaataaggtagattttagtgtataaagccaaacgtgcaaaaatatatgttcctgagctataaaaaggtgtatgcataaccaaacaaatctcctaaaaaactgacaagcatagatttcttctcctctgagcatataaaaattagttaatttctgaatcttgtgttaacttccaaagcatcttcaggaggacatatgaactctgaattcttgcaggaacaccgcttctaaattgcactccagttctgatgcgctacccctccagcaaagccatacatgaataaagagctttaattggggagctgggagggagaagcagcgctgagaggaaaggaagtggcattcaatggcattcagtggcctggggaggaagtgacatccagcgaagggtaagaaaaggaagggtaggaaaaatgcccaggaaattccaaaacaccgggaagagagagaaagagaatatgaaaaaaaacttcaacccatcaatggagaataacaagctcagtgttataaaaggagtgatctaggctcttttatatgagtacatgtctttattatgtataatatatatgaatgtatatctatatgtaagcctcgattattaacattacgaggtagacagtaagcaagtcacattctatcttgcactctcttacacgcacacataaaaagcatgttttgtcattagtttctgtcttcttttacaattaagaattaatctaggctgggtgcagtggctcacacttgtaatcccagcactttgggaagctgagatgggtgggttgcttgagcccaggagtttcagaccagcctgggcaacagggcaaaaccccacctctacaaaaaattagcttggcatggtggtgcatgcctgtagtcccagctactcaggagcctaaggtggaaagatcacttgaacctggaggttaaggctgcagtgagccgagattgcaccactgcactccagcctgggcaacaaagtaaggccctgtctcaaaaaaaaaaaaaaaaaaaaaaggaattaatccagcaagaggccaaaactggactgcttcttttcctactggaccttatctttagggtcactgcatgaggagggcaggaatgggagggaaaggaagaggcccagggctgggaaaatccaccaaatccacatgggagctttgatcttcccctttgaactaacacagctatggcttttaaccttaggaaatgtccctgttcttctaatggaatgagtaaggatccagagccacaggaacactttgtccatggcgttcctagattgacctgatggggcatctcaagtgcacaagtgcacacacacatcacttgcagagacagcaggggacatggtggagcagccacttggaagccatgcagaaagctctgtcgttccctcgttctggtcacttaaccactttacacctgtttcctccacgtgatatagagtgggggttcaacaaatttgctcttttccctttcatctcctgctgaagttattacataggtgttgttcttgatggtccccaggctgtggggtaccttgtatttctttccacacattgctggttcagttggatgaaaaggagggcttcacagagaaagatgagcattcatctcaactttctgaaggatgagcaaaattcagagagaggggtaggaacttaagattttagaaaaaaacaggtaactagaacaaaaaatatataggcaggggaaaagaagctaaagaaatagcaaaaaattagacaaaagagggttcagactgaaaacagcaaaatgcaaggtccattagtttgttaactggttatcaattgtattcaagtggttttggcctatgaggctgactgacgaagaaagcgaaaaatggaaatgggaaaggtattccatttaaaagtatctgcatgtgtccacaccatgttccattcaagcctgggagctaaagattacaaattcttatttaaccaaatgtaaatttaagcagataaataaggtggcacttatcaacaatttttaagaagccattaagaatgagttctgtgatgcattaaaaattatctaaagttttaaacaaatttccaagaagcatctcctttaagaaatagcatcactaggccaaggcagatagatagcttgaggccaggagttcaagaccagcctggccaacatggtgaaagccgtctctaccaaaaacaaaaactagctgggcatggtgatgcatgcctgtagtcccagctactagggaggctgaggcagaagaatcacttgaacctgggagacggaggttgcagtgagccgaaatcatgccactgcattccaacctggatgacagagtgagaccctgtctcaaaaaaaaaaaaaaaaatagcatcactatgtccacactgcgtacaaacatactagtgttatcttcacccaactctggagtttctaaatctgagctacgtagacctctaaaaaattcatggatgaacacaatgggatccataagcctgctgaaattagaaccatcacgtgcacttctctatggatcagggttgtagttttcactctattatttaaaaaagtcagtgacttaagaaaagttaagaaggccaggcacagtggctcacagtggcctgtaattccaatactttgggaggccgaagaaggaggatcacttgagcccaggagatcgagtccagcctgggcaaattagccaggcgtggtggtgcacatccatctaggaggcttgcttgagcccaggagtttcaggttacagtgggctaggatcatgccactgcactccagcctgggtgataaagacactatctctaaaaaataaaaacataaaaaaagagaagagatgctctagaagaatgtatgtacctaagtatcgcacttcttagtgtatctcctctaacatcctgtacatacactcacatgtacacacacaccaagttatttaggagagagtgcatcaactgaaaatctatgtataatattttgctattacatcaattctgtttgatagacattctatcatcaatagcaaaagaaatctttttcaggatcagccgtgcacatgggctaactaggagttggaaagtgacagacttacactcccccatcttattttctccacagcctgccaccgttctgaagttctcacgattggggtggttccatttaaaaatatactgtggaggaattagcatgttagctagctgccacttagcacagtacaggacctcaagaaaaaggattctggaacaggtacattttggttggtggggccgagaacaaagagaatgggggcaagggggtggccacagtctacaagctgagaatagataagatgccatcgggcggacacttcttcaacttcacccgctggccttgggttgcactggttctgggtccctgggtcaacagatcctcccatgggacaatctcaggagctcactcactaaagacaaaaatagcaacacatgcccaattgccagtgatttctgctcctctcccttctgccaccctccaccctattaaatgaaaagaacattccatgctcatagataggaagaatcaatattattaaaatggccatacttctcccccagatttacagattcaatgctattcaatgcattgaatgttaaaacccagattctcaccgtgtgcaatttgtcagtggccaatgtggaagaactcagaagtgctccttaaaaaatactgaggtctcggggcaggcacagtggctcatgtctggaatcctagcactctgggaggccgaggcgggtgctctggagttcgagaccagcctgggcaagctgggcaacagagggagacttcatctcacaaaaaaaaaaaaaaaaaaaaaaaggcagggtggtaaagaaaaggacaggcagcaccattgcaaggacaggtagcaccattgcaagctggagccaaaatgatatcacccctgatgggtcctcctttttgagaatcccattatctcctatgaatcctgatgttctgaaaaaaatgtgtgagctgcttggctaagttgcaaatgatggtagagtagattctcaggactgtattttcatgctgtttcctttctttcaatgtaggagacaatgacttggcccagcagctagcagttctctgtggcagagagatccctgggcccatccggtctactgagagtacacattcatccgcttcaccttggactccagtgtaaccagggcaggcttcaatgcatcctttcacaagagtaatgagtttaaatatttttttaatcccatgttatcccatctcctctcctttcctctctctttctctcttcttaatatagttttctgggcaccaggacgcaaggcaagtcagaggacatgggtctctgcccaggttctggatggctggctccccttatgtcaatgctgagtcctgatccaaagcactgtggccaagtagtacaaaagtgtcctgccttaaggtctctgggtggggcatcttcactccagaggaggtgtgtccatggaatgcatgagagagagctttaaagcaatttttcagcctaactaagggctggaactagagcacagctcatatccataactcatcgaaggagcaaaacatcatcatttatccttataaattacttggttaaagtcatccatttgagggttggcaggaagagtttgttgctcttgaaatatgaacttgatgagtcaaaaacaggcaccatatatgggatgccatcatgcacaatatgattgagacttttaaaacttgacatgtgaagtccagtaacagccttaaatccaaatcaaatgaaaagtaataaagtagtccatggaagagtgaaagactcccatgtttttaactgtaaaacataattttaaagtagattctcaatctaacattaaaaattaatctaatatttcctccatgcttatatataccttttataaagtagggagcaactgacgataaattgtgttcctcacgctcaacagaggaaggctgcatagtggcttaagagcatgggctttggaattagacctaagataaattttcacctctgcaatttaactagctctgtgagctgtctacctttccttgctgatgagcttctagtccctgaaaactggagaattaatgcctgctcctttcatcctcttccttcatctcctgccctctcactctcatgtatatattaatatgtatggcagttcattatacatacatacatatgtatatgtatatagtgatggtagaaccattgtaatttatttgtatgtgtgtatatatgtgtgtgtatgtatgtatataatatatataaatatgtgtgtgtatctatgagtgtgtgtgtgtatatatgtgtgtgtatatatatatatatacatggcagctcatggtctagaatatatttcaaatttaacctgtgatataatggactttggagactcataagcaaggaggatgggtggggtatgagagataaaaaactatatgttgggtgtaatgtatactagtcaggtaactagtgcactaaaacctgagacttcaccagtatgcaattcatccgtgtaaccaaaaaccacttgtaccccaattagatagatagatagatagatggatagatagatagatagatagataattcataacaaaaaaaattaacctttgaaaactgaacacttaattcccacccttttccatgccactacccccgcccccagttctacactcctcacaatgttagcaaatggaaagtacatttttctcattatttaaggcaaaaatcttgatgttatttttgatgtttctgttggtctcatacttaaccatcaacaaatcacactggctctaccctcacaatgtatctagatttcaaccacgcccctccatttctgttgctaccagcctagcccatgcgcctatcatctctccttggcctcaggcagtcccctttttattggacactctgctcctgccctttgctgccctccactccttacagtttaaggactgcacatagagtgatattttcaaatgtaagtgagatcatgccattctgaggcccaaaacactttgtcttcctcttcttactcagagtaagtcttttcagtttccagcatgacctagacatgctgctacctttggaatctctcattctgcctcatccattctgacttccatgatgtacctctaccacatcaagcctttacactaactgttttctgaactggaatgttttctcccacatatccatctggcttgattcttttatttcattaatgtctctgctaagatgttactccaatgacgtggcttttccaacttaactctgacaataaagtacccttctccctcctcccgtccatttttctttatagaatttatcaccatctcacatattatgtatttgtttattttatgtcttccccatctataaagaaatctttatgaaagtaggtaatttgtcttcattacttacctctatatcccatatctcagtcaaccaccacaaactgagtagccaatagcatatgctcaatacatgcttgttatactaatcatttcctacactctggctttattttcaagaatttttattgcctacactttgaaaaccccccaagaaaactaagaaagcataaaaatccagttgccaatcctatttaaataatctacctttgtttctttgtgggaaggctgcggcggatatttgcatgcagacacgggatcattacgtcccccaagtatccggagacctacccatccaacctcaactgttcttggcacgtcctggtccaaagtggcctgaccattgctgtccattttgaacagcctttccgagattcttcttgcaaccagggggattacttggtggtaggtcttgcttgctaccctttctaattacgttttccatagacttcattcagaaaacaaaatgataatttttctctcctgggacataaatggataagaattatgtactctttcttttgcaatgtaaaggagttgatgcaattttaatttgtctttccagctaagaaatggtcctgatatctatcctccacccttcggaccctgtggaggaaatgttcatttttgtggcagtcgtgcttcatcgactctgttcacctcggataatcaaatgtttgttcagtttatttctgattagagtaatgaagggcaaggatttcagatcaaatatggggaaaagagtttacgtaagtattttcactgagaattatatatacttttcctgcaattgcttggtcttctttgattaaatagatttgagaaaaaacatataaagttttcttttctgaactaacagtaatagaattaataagaatgcctactctcaagtacttattatgtttgatacattcaatatctcatcgtgactacttttcaagtaaagtatcattatttcgattttaaagataagtaaaatgaggcttggacttttccaaggccacatatctaattagtgaccaaagtgaaatgttccatgagtataagatacgctattcttcttgatccctgaaattccttagacctttccattataagatgtctaattgtaagttaaatctagttatagaaacattataagaattacatttgccctattttgtaataatgtgtatgctgtttttaaaagaatacataatcttttgattctattattactgatttaattatatattacctaagatctttacttaattgcttgtacttaattacacttgattataattgcatttaattttactgtaatgatttgattttggggacatttactttttagtaatgtttaattgaataaataaataaataaataaataggcatcacttccaaaaaacggagtaatgtcagtagaaagcaatataataataaatttttgctctgtcccaccagaagttagataatatagatttcaaaatgatcctattacttgtatcccagattcctaaatgcatttatatatatatatatatatcagtgaaatcatgttttattgcacattgtatgaaatttaaagtcaacatcatttcttcattttgctaaaagaaatgagtaagagtgtttaccaactgacacacaaaaataatcgaatagctggagtaaggtccaaaacaccagagaaggggctttggtcacttcccagtgcacagagctgtggcacaaggagggagctttaatgcagctctgtgggcatctgcactatggctttctaggctgggaccttctcatccctccctctctccatgctgagctttgcagctgagtcatgaattggcaggttttcacctggtaccaaagcatttcaagagtagcagtgtcttgagtctagtgagtagatgtcagcccatcctataggactctacttttctatttttatttatgataaactcagtctttttttctttcttgagacagggtcttgctctgtcacccaggctggagtgcagtggtgcaatctcagctcactgcaacctctgcctcccaggctcaagtgattctccttactcagcctccctagaagctgggattacaggtatgtatcatcacgcccagctaatttttgtatttttggtagagatggggtttcatcatgttgcccaggctagtcttgaactcctgagctcaggtaagccagctgcctcagcctcccaaagtgctgtgattactggagtgagccattgtgcccagccaatagacttagtcttgatttaaatttttaaagtcaacatttaatggtaattcagatacactatttgacattgcacctcttctatttctttgtggactcactgttcatgcaagtatggtcatggctgttgctttctccctatctttcttgaagcttgttatgactgccgttaacatcagacttaaacaaaagtattttgatttcacaacctattgttggcaacctgaaacaacagcatcactcttatttctctctacttaccaactcaatcatgttccataactatagtcagccttctacttcccacatctatctggctatcttcccaccatatctacttccatgccactcctatttctcagcctttaacataggtccttttgtgaacatctttcgacactgaatcacctagttttataccgtttttctccagagacactccttcgctatggttgattgagatttctaggatcctgtggtagatgccttttattctcaccagattaataggcctattaattaatcaatcaaacatttacaaagtgtttcacatcatgaaaactactagagttctggcaaggagttcacagcttggtagacgagacagacaagcaaaggcacagttagaacatgatgtagggctggacacggtggttcatgcctgtaatcccagcacttcaggaagccaaggcaggaggatcacttaagcttaggagtttgagaccaacctgggcaacacagaaagaccttgtctctaccaaaaaattttttaaagtagctgggcatggtggcacacttctgtggtgccagctactcagtaagctgagttgggaggatcacttgagcccgggcaattgaggctgcagtgagccatgatcataccatggcactccagcctgggtgacagagcaagaccctgtctcaaaaaaaaaaaaaaaaaaaaaagaacatggtatatggtatatggtataataagcgctacgtacagaacagaaacacctacttcagcccaggacatcagagagggctccagaggaagtagatgaagagatttgccaatcagtgataaaaagatgtgagtgcatagaaagtctcaatgttaaaagtcatatttaataatttgaaagaattcaccactgctttggaatagagtcaaaaagaggtaaacataatagtgatgaagcaggcaggaatcactgtgctcagggccatggatgccaccgtaagttagttagatgttaatcaaaaagtaatgggaggcattggaagattttactccaaagcctgaacagtgtgatcagattaaaaacactaatgtggctgcaacactgaaaacattggaggcagggaagactaaagagagagagaccagatgaaagagtaatttaggaaaaaatattactccctgaactaaggcaatgccagtaagaaagtaggagagagggcatatcaaatatattatcaacacgggatggagtgaatttggaggtcagctggatgtgaggcaggagggaagggatgggaggagccttaggagcagttgttaggtttttggctgggtggatccattcatcccacagacatttattaagaactttccatgggacagacactgtattaggtcccggggatatagcagtaaacaaacaaaatccatgtcctcatggagcctaatcctagtgttaagacgtagacaataaataagtaaaatatataacatgccatatggtgaaaggtatccaggagaaaaataaggcagtaagggtggatacagagtgtccataggaagaggggctgatgctgtcatcagcagactcaggtatggaactctggatgatgagcaaatgagagtgttcatttgagacatcttcagtttgaaacttctgaattacccccattggagatgcccagtaagtggtcggaacaggagtttggaggacagaacaggggtctagactgaatctgtaaatatcaacagaatttgaattatccagaatttggaattatcaatagactgcttacagtttaagtcattaggatgtataacagcaattggggaattatttagagtgagaagaaaggcctacaggaggattcctgagggccttcagcaatgtcagggaagccctgaagagaggcgcccaagaaccagaggcagaatgatgcgaggagtaaaaggaggagaagagcttggtgtcacagaagccaagcgacaaaaatgtaaagaaagacaacgtgatcaacaatgttaaatgctgtggatataaaataataatttaaaaagtcatttgggcatataactgcgaggtgacttgggagaacatgagtgctttcatagggttgaagaaagaagggcgaaaagagagaaagagagagacagacagacagacagagagattaaatagaccaggatcccggaggagacaataggatgggaacttgatccagagatacaggaagataatatacagaggagaaaatagagtgtagagatgtggatgaatttattaaggatagtaacaaatgaaggctaaaaaatggaagggattattatgtaatttcttctattttctttgtaaagtggagcctaatgtagtgtgctgagaaccaaaaggaattggggaaagtcaagggtttatggagtaaagttacaaaaggctgttgtagtttatatgaaaagaaatgggtgaattgcttcgcagtgttgagatgggagaacgtatatttgcagaggcatcagtttccatgaatgaatggattgacttgaacacaaccacggagttggtattttgcaagggaagtctgaaggaaagacatgaagcaagggagctggaggtcatcaaagggatttgcaatttagagtttcagagatgggggagttggaggtattgacagaattcaggatgtgactgtaagtggatgagtgacagtggacataaatgttgctagagttgagcagatcaagtatctgtgtggctaagtgattggacaggttaatttcactggcattgtaagtacatttactcctgtctggtttgtttgttgaaaatgccaaagaatatttattgataatagaaaagtattttttgataatactttgtttttttttagaaaagaagtattaaaaagctcctttatcttctggcaaaacatggctaataaattgtctgatgccattgatcttgtttctcaaatgcatctaaatcccgaagaaatgtaatgaatgaatgctcccagagttgtgcaaagatatatctgcttagtcttttaaatataccaagatcatagctctgcatcattctgctgtactgaacgctcagtgggaagcggtaactgctagcatacttacatgcttatcgaagtgctggatatttattcatgcttctgtgatgttctgccccatgcacatgtgccataatcatttggttggttttaagaaagaatgaaatttccaatgagaatagatagatggtctggcaaattaaaaagtgtcacacctggtagctccctccatagcaaatagagaattcatttgctgggaaaaaaatgaggatcataacagatgaaaggaaattgagacaagttacagagaattcgactttaaaagatgatttgtgtccattaaatgcatctccttcaccagatcgtagactgatttaactgtgtttgctgacagcctgtgggggcaacatctacatccatgaagctgattctgctgggtatgtgacctcccccagccaccctgataattatccccctgcacgctgattgcatttggatcttagcggttccaccggaaacacgcatacggctgcaatttgaaggtcaattcgatattgaagtaacacccaagtatgtcacttccattttcatttttttcctacccgaagttagtattttttaactgtcatgtctcagaacaattcatttctttcagtagcacatactgcaagcaaatctagggaaaaagggaaatgcttaataactcaggcctgaaaacagtctgccagcaactctctcatcagctgagcaggttatgtacatgggtactgtcctttgtgaacctagacacttcctgcaagggacgctgagggtggctacttgagattgatgtttatccattcttcctcccacaggaaatatatcgtgtttctgagagatgaatatttatttgcccagcctcgtattcagtgtcacaaatgataaaatgtctgtttaacaaatgggaatttgtgtggtatgtcaccaggggtcaccagtgtcagaacagtactaaagcacttacagtataatttcccagtctttatttaataagagttctgaaagtattacaaaacagagagtaactcttactatattgaagagaaaggaaaactatatagattgtaaaaaaactgtttttctctttcctttaacaaagtgtgtatacgtttgcatgaatgcagctgtggtgcaaaacttagatataagagcttttgttgctatttctggcactggatttaatactactcttccactcatggagcattaattagctgatgtaacttcctcgagaaacgctagatacatgcttgtctacttttacggacacagaaaattccggttgggactctccgttagtcccaattacagagctgttagagaatttatctttgtcatgtgaaatgtatcaaatcactgtgtggaacaaaatactcgttgttttttgaaattcgtagggattaatttgaaaacaacatttatatttgtaaaagcaatacagaatatggaagggaagtaaatattcttcaatgtaggacatgtaaaccctgtctttttgagctgctaatgaaagaatgtattactatgaaaaatgtcatacagcattttaatgtgacacgtggcttacgctgattctatcatagtcttttatgctaagaaatgatgatttaataatatcgtcaaagaaagtaagtgaagttgtcattatcaaaataagtcaaggcaattgaccatgtaaatttaacataattttgtttccgctttaactgtacttctaactacctctagttgtgggatggagtggattcagatgcaccaatactttccaaattttgtgggacatctttgcccagcagtcagtggtccttaggagaggttatgtatttgagatttcgatctgacaacagccccaatcatatgggattcaaggtcaagtattctatagattatatatattttttaacttttattttaggttcaggggtacatgtgcaggtttgttatataggtaaacttgtgccatggggctggttataaagattatttcatcacccaggtactaagcctagtatctaatagttattttttctgctcctctctcttctcccaccctccaccctatcaaatgaaaacaacatcccatgctcatagatcggaagaatcaatatcattaaaatggccatactgcccccccaaatttacagattcaatgctattcctatcaaactaccatgacattcttcacagaactagaaaaaaactattttaaaactcctatggaccccagaaaaacccaaataaccaaggcagtcctaaactaaaagaacaaagctggagccatcacaatacctgacttgaaactatactacaggggtacagtaacgaaaacagcatggtactggtacaaaaatagacacatagaccaataaaatggaatagagagctcagaaatagggcctcacacctacaggcatctgatcttcaacaaagctgacaaaagcaagcaatggggaaaagactccctatccaataaatgatgctgggagaactggctagcaatatgtggaagattgaaactggaccccttccttataccatatacaaaaatcaattcaagatggattaaagacgtaactgtaaaacataaaactataagaaccctggaaaacatttttatgttaaataaaagagtggttatagaatgaatatgttaaaacttttttttaaaccatgactttttaaaaagaagtcattctatctgcctaattttaaaaatattttaatgctagaaataaggagtgtaaatgtttaaaaccacagtcatcaactttaatttctcttttaatttttattttaaaatgtaatcttagtaaacctgaatattttatattttttctaacttatctgggaagaaatatgtgtagttaaatcaaactcctgtttctcctgcttactatgaaattcagtagttctctcttatccatggtttcatgttccatggtttcaatgcacttggtaaacagaggcccaaaaaataggtgagtacagtacaccaagatattttgagagaccacatttacgtaacttttcttacagtatattgttatgattgttctattttattattagttattgttgttaatctcttactatgtttaatttacaaagtaaactttatcataggcacatatatatagaaaaaaatcgtctatatgtctatatagggtttggtaatatctgaggttttaggcactcactgggggacttggaatgtatcccccaaggaaaaggaagaactacagtgtgtttattactttaagtaatacaactatttaagaaccagataactatatttagaacaatgtctttgaattcctcatcatatataaaataattaagctttttttttttctctgagtctctagtgccaaatcagtcactggataaaaagcaaatatatctcttcaggattttgatttccttatttaaaaattgagcagtaactttgcttgttgaagattcactatagtatggtcacaatagcacagaatttagtatctaataggtctagacacaaaccaaacaaatatttaatatagcaaaagttcagaaagcctagttgtaacaatatttagctacaccatagatcatgttatatcccgagtcaagctgcatataattcaattagctatcacatccagctaataagacataattgaatagtaattttcaaggccttgagatatcagttattgtagtgaacagtttaattgatagtaaaactagaaatggcaggtgtccccccttccagctaagcttgggttcagtctttagaatcaacacagggttctaggcaggtcagatgagtctaccagtttgttcttgagatgaaacttgcttgcaactaatagctcttatatagtgtcccaaaagaattaatgtgacattacagaatatgccatttggccgtcatcttgtttcccattattggattggacttgtggtatcatttctgtttatatcaaccctagaattcaaataatgaggaaagcactaaccattttcagaattttaaaaacttcaattcatagtcacttggcacctaagttttcacatgtgctggtgaaatgaaaaaaaaaaaaaaacaaaatttgtaatagaatctttctttctttctttctgtgtttctttctttctttctttctttttctttcttttctttcttttctttttctttctttctttctttttccagctcagtgtggggggaagagtaacagggcaaagtggtgttgttgaaagcattggccatctaacgcttccatatagagacaacttattctgtgagtggcatctccaggggctctccagacactatctcaccaactctttcgaagattttaaccttcagaattcctctggctgtgaaaaagactttgtggagatctgggactatcatacttctggttagtgaaatatatctgctctctttggggtgtttattttcgcatgtacttattcagcctctgaagtttctgcacttccgagaaaggcaaaagcatgtctatactctgcagagaagtgcagattaatgagctttgggcagtaccagtgattctctacctcaattctaccattacaatggatgtccagagcccaggtgtcatatagcctaccctggaggccacctggggagagcaatggtagtgggaaggcaacctgttgctgctgaggcatcccattgccacatgccattatttgaggggtgttctatagcttgaggcagacagagggtcatgcatgtctcctggcagtagcataaggcagatatttgtcactctgtttgtctcagaccactttttcaaccagataagcaagccttcctcattgtcctgagatatccttcccctaactggttgcatttttttcacttcttcatatatttgaacatgttaattttcattcatgttttcctgttttcttgacagagagtaacttttcttcatgggcaaggtcttgttttttattattttctttgtatacgcaggacacctcgaatagaggttaaaagaaatcaatcacctggacatatatatttaattatttgtctctcacaggaaacatcttgggaagatactgtgcaaacaccattcctgacagcatagacacttctagcaatactgccgtggtcaggtttgtcatagacggctctctgactgcctcaggattcagactgcaatttgaatccagcatggaaggtgatttcattgattaattcaaaacaacattgagcacctgcattggacagacactatgctaggcactggtgttacaatagtttgaaaagcaaaataaaacatgacctctatcttcttggaccttaatcaaaaagttacactgacaaatgaaaaattacagctgtgatcaatgctataagggaaaactagttataataagaggatgagagttatactgcaatgcttgccttaagaaagtcctgtagttactcagaatttgctttactgcaaatccaacaaactcagatgaaataaagatcttgtttggaaaaactggatacttacattaacctcctgattttcctgattttttttttttgtaaaaatagggtcttgccttggcctcccaaagtgttggggttacaggcttgagtcaccactcctggctgattgccctgattcttttttttttttttttttttttgagatggagtctcactctgtcacccaggctggagtgcaatggtgcgatgtcagctcactgcaacctctgcctcccgggttcaagcgattctcctgcctcagcctcctgagtagctgggattataggtgcccgccaccacgcccggctaatttttgtatttttagtagagacgggattttaccatgttggtcaggctggtcttgaactcctgacctagtgatctgcccgccttgggctctcaaagtgctgggattacaggtgtgagccaccacacccgacccgattttcctgattcttaagttcattatattcattggtctcttatatttcttgggtcatgatgataattaaattgctgtctgtggactatcatccatggaagccagggttaaatattaatagagataggaaatgaatgtatatattcactaaaatcctcacacacataaatatggagaataattttgtctagaagggtaatttttaaatacctgaattttgagagctttcccgatggaaggagatattttgatttgattggaagttttcttggctttttttcccccacaccagagtgtggtggggatctcagggctctgctggaacatctacttctcccaactacccgaacctaaatcctcatggccggatctacgagtggagaatcaccgccccagaaggaaggcagatcaccctaacgtttagcaacctgaggctggccacgcatctgtcctgcaacagtgagcatgtgatagtaagcgttccctgtggcctgagatgttatattccatcatttaaggagtttactgacccataaatcatagtcagaaaactaggtcaggaaaattgctgtctatgcaactataactcagacaaattctaagtattgttgagagaacaaaacacggtaaactgtcaaaataattgtaaacattgttttaagagactatcagctatcactccatgcatgagggtcatagatagaatacattttaagagtgaatgataatgacaaatggcaaaaccggggaggctgtgggaagctaagcctacaggagcacatagatgaatgggaccagagtcacagcacaagccaccaccgaaagttctgagcagatgggttgtcctgcataatgactgctctttccaggggtgcagagggactcctggtgggagagcactactacctgacctccatgtcgccaacctccagtggtttcagatgtgccctcagcactctcagcttcctgcagtgaaagaaagcaaatgagatccctgagtgtgaataacaaatagattgttaactgtgaagtgctatacatacatatgtgtgtgtagataggtagactggattaatattagtacatttctccacccaacttgccccttctgcagtatatgctatctcagtaaataattccaaacttctggttgctaaggtcaaaaatcttgatgtctattttggaatacttcctctcacaccctatatggcatctacaagcaagtcctctcacaccctatatggcatctataagcaagtatctttaaaaatattcacaaactacttgttatatctactactgccacccccaccgttcacttggattattttataagttccctctggtgcccctgcctccattctcatctccctacattctcaacacagcagcatgtgatggttttaaacctcaatcagatcatgttgctccctttgaaaatcctctaatggcttctcatctcactcagaggaaaatcccaaattgcacctgtggcccacctggccaacattatctgctgcccctccctcttctacctgtctgtgttatctcaaactcccctcttctctgctcgctggggtccaggcacctggcctccattccgttccttgaatgtgctgagatgctccctgtccagctgttgccttcatctggaatgcccctgttcagatggcagcccgctccacaccctcacttcattcaggtctctgcttgaatgccttttaatccatagggtgtaagtatcttatattacagaccccaccctagcctgacacttctctgccatgttgttttatagcactttacaactgctgccatacatcattttgatttgttcatcagtttattgtctgcttcccccactagaatgtaagctccttgagctcaagccatagtttcattcactgctggggactcactgaatccccaatgcctgtatataatagagataaataattgttgaatgaatggatagtagaggtactatcattatccctttaataagaagccacttttgttttcagtttaattgtctcctgttgggtggtgaatctcaaaaatatgaaatatatttgtaacttatgaccactttgtatcaccctaaaatgatctcattcaaccttcagattttatttccaagttctaatatctgaaggacggaactattgtctttcagatcttgaaaataagaaaccaagtgtgttttcttttatttgagagccaggaaattttggactaaggttgtttattataaagaaactttgtttcctattattgattgaatatatataaagaaagatgaagtagaaaaaatactaaccactcccactataccatattttgatgcattttctcatctcttcttggcaaagcatattttaggtacttgtaatcatgtgatataaatccacttgaattctaattttagtctatttttctggttataaatatcatggatgcttattgagcaatatttggagagttcagaaaataaaaaatataaagatatttttaattctactcatctattactaaaatttagatatatatgctaacagttgttttttacctttgaaattatttttatagtttaaatcatactgaatataatgattattaggaattttacaagcagagtattaacatgtcctttaggaaagagaatacgaacagtcatagttttggaactcaaataaagataaaagttatagccacaaccacaaattccaaagcagatcttacttgtcatctctctataccttaattatcaacttataactcttgcagctactgctggtgggttttatgtccttatttctaaataatattcctattctactactccttgctttttttggacattatctatccacatcctactctggaagatgagaattagccctctgccaccacaaatgcacatggggtatacacagtttatatactttcccaaaagtcccccaaaatacatatgtcacagcttttgctgaaattgtcattcagttgacattaccatgattatgtaaacaccattcacaactgagccaagtagtgtactatggcaacatttgcttttgttttcccaaggaataataataattgtgccctctttacattttcttgggttttacgcattgatcactaattcttccacaccctttccaccctaggtgtgcatcttaaccttctgtagtaaaacatgtcagttccatttcttttcctcagtaatatccttccttgagcctttgtccatcagctgcaagcctgatgatagctgtcatttcagaatttccctttgccatcagatttgcaagttccttcattctgctcctgggctagaaagctggctttgtgttgctatgtacatccctttcttggttaatttcctcttttgtgaggcataccctcttgtaactccccaaggaaatgggcaagggcaatacatattttaagaaatgatatacctgaaattatctttattttaccatcgttcttcgaaaaatatatatttaaatattttatatgttcactatattaatatatccatgaatatattaataattttgaagttttgtgtggcttatctggggtcagttttcttcatgttcctatctcgtgtttacttatattggtctctgccttttacattagtcacttccctaaatatctgctgatccttggctattcattcatatttaagaatgaattactgaaaggatgactggcatctctgtatgcatgagggtgccttgactctttaaatagggaaacctacaaacctacaaatctcatatccacaggtcttttctcttggggaggttaaaact

SEQ ID NO: 555 - DNA, 38716 bp, Homo sapiens
gagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaact

SEQ ID NO: 556 - DNA, 42300 bp, Homo sapiens
tgagcacattttccaaatttaaatttagacctgtaaactggtaatgaggactatgtgaggacttaggcagggtatggcattcccacgcatccccagaggaccagtttttataaacttcacggcaaagaacagaacatgtccaggtagcgttttgccagtgaatagccattttgggcctctctccagtggggatctctggcttctcttctttatcaaccactctgtcttggccaggcctggtcagcaggcagcctagtgtctgtctctcggggctgtgcaaacttacctactatcccctggcacagatccagccttttggccttggcaaaataaaactggggattgctgtgcagctcctgggaaagacaaacagaattgtcattctgacctagaacaaaaaagctcctggagctacagtgaccacgttttcccataccccaaaactgtacttatggggacaaagatacagaatataggtgtaatcagtgctatcccagaagatctgggatacagaattctgtcctttgtatttctcattccttcttatagctcgtgtaagtcagagccctggagaactctgtgtagatattgagaaatagcacttataccaaaaatgccttttcttagagtttctattaaaaatggaaacacttttataggaggtattttcagttttcctagatatcttctctttcgcttttttctcccctattcctccttcttattcctgacccctaatatgatgttctttttggcttttcctgatgcgatgcagcctgtgatggggtggtaggggggttgtctctgctccgtggcaagatttatattctcagtctttgcgcggacacagtttccccaagtcagatgtagaacagagtctctatgtcagcagttcccaggattttctgagagaagtaggatcttggctgccatgtagtttaggaggctcactgcagaattttacacacagtagggacttcataagtctggggctgcaggtatcgatggtgatgggtgagtagggaagagaaaaggaaagtctgtggcacaggcttacactttaccctgttcactagctgtgttcctgaaatcttgtaggtaaatcaagtttcagggagatggattacatttgaacacattaagaagttgctttttaaaggaattgatgcattttatagagtgaagaatacttttgtaaagtgattaatagcttcttaatttaaatgtttcatgaacctgttttgggggtaggaggttggagagatgttaaaatttatctctctggcagatggtattggctgtgactcaggaagccttgccatctcagatgaagctaaacagtaccttgatatatttttggctatagctgttctgcatatttctgggcaggactgagggagggctacatcttagaccattctcaaaatcacccttggttttttccatctggaaagtgagaatgtgggaacatacccatcccttctcatggagatcaatgacagtaagacctggtgtgatattgtgaaatatatatttggtcttcatttgctcagttttctgacattcagctcctaaaaccttgggaacctctagagtgataagagtgtccttcgtatgctaatgattgactggtgactggtggtccctaggtagcttcaggatagggtctggtcattggaaagaccaaggcaggattagaaggttgggagtttcagccccaccccctgatcactggggaggggagggaaactgaaggttaaattgatcaccaaaggccaatgatgtaatcaatcatgcctaggtaataaagcctctataaaaacccaaaaggacagggtgtaaggagctctgaatatctgaacacacggaggtccctggagggtgccacaaccagggagggcatgagagctccacaccccttccccatgccttgccctgtgcatctcttccacctggctgtcatctgcatcctttgtcataccctttaaaataaatcattaaatgtaagcgaagcatttccctgagtcctgtgagcctctctagcaaattaatcaaacccaaggaggggatcatgggaatcacggtcctgatttatggctggtcgtgagtacaggtcacaacctgggacttgtgattgccatctgaagtaggggcagttttgtgggatgaacactcaacctgtgagatctgacaccgtctctaggtagacagtgtcggaattaaatttcattacagaatacccagatggtggccaccagagaattgcttggcatgtggggaaaacctcctacacatctggtgttagaagagtgtgttgtgttgagtggagaggagagagtaggaaaaagcctgtttttttctcccatatatcttaggcgcagtatctgaaagccctaaaccctggggaaggagggtctgggctgacacattttgcctcaccgggggcctcttccactgcaggcggggtggcagcttctgcagcagggagccactgccgatggagctcagggtggccgggaagctggtgtcttcaaagaggcagccattcctcaggcactctgccagcagggcctcaaagtcctgttggggttgctgtggagacgccctcctagagtaccttggcgccagcttccatctgcatcggaaaggtggccacagagacatggcaggtggtgggtacagtccagtgagtcttcctgaggagtctctgctgctcctgaaatggagagaggacggtcagtttcctcacttcctccttgtgctttgccattgccacagagacgaggggaaggatggagagaatgggagcggagaagtcagctggtgagaaagagacagaagcaggtggttcgattttgtcccagagagtgtgggtccttgagcactcactcaagtgcttgaggacctggtgggagatcagggatcttgtggcaaaagcctacagaagggaaagttctctcaagcctcagggctgagtcctgggcccctgactgcaccaatgtcacgggggtcccttctgcttagtggggaggcaggagaagagaagcaggaagctggagctcagtcccctgggccggagggtcctgtgcctgccaaggtagtggggagtagtggctgcctgctcaggcctccaccaggcctgccaactcctgcctcccagctacagacacacagcattcctcctgcttcaatgtcctccttattcttccctgcaaaacctcctcctacattatctttattttttttatttatttattttttttttttgagacagagtctcattctgttgcccaggctggagtgcagtggcgcgatctcggctcaatgcaacccctggcttccaggttcaagcaattctcctgcctcagtctcccgagtagctgggattagcaaggccgcagggggtgctgggggccagcagctcccacgtggaggcctcccaaggatgtctctcccatcccaggagcccccagctgcgctccgggtcaagggtaaaaccccaggctccagcacagggtgcgtgggtctctcacagaaggcccccacgggcggtcacaggctctggcagggctgcaggttggcgtgggcgagccggcagtgcatcagatacagacgcccgccaccacacccagctaatttttgtatttttagcagagatggggtttcgccatgttggccaggctggtctcgaactcctgacctcaagtgatctacccgccttggcctcccaaagtgttgagagattacaggcgtgagccaccatgcccagcctacattctctttacaaagaaatccttccttgaagactttcttgctaatgtaaaagggggacaaaaaaatcacacacacacatattgtgccaaataccaacagttgccagtacgtgcccattctccccttttccttgttaccagaatccattttgataacccagctacaaaacttgatttcctggagcttcttgcaggacaggttggctacacaatatagtttttcattttacagttgcaaaaccactaatcttattagcctccccatttttcaggtgttacaactgaaacctgtccattcattcaccaaaaattttactgggaacttatcatttgtcaggcttgaggtaggcactgctcaccaaagacagtccctgccctcatggctcttacagtttagagggtgggagagcgagaagggttaaatgatcttcctggtgctatacagggagattttataagggctgtatccagaacccagagccctgactcccataacaatgttcagctctcagtgctacaaactgcctattacaccccgcacagtgtttgggacagaatgtacatgccctaaaagtaactcgcaaatgtgcttatactgagtgtgacttctccctcatggctgtaggagtgacctggggtcctctccatttgtcaaggtcctgcccatcccccaaagtctaacttgagtcctttccccaggaagccctccttgagtgcctggcattcgctgagatcccctcattctgtctatggacccattgtctgccccattgggcacctactgtcttggtgcttctcaaattatcactagtgaagggcctatgttcttttatttccgatttgtcatagaaatttaatgaaaatgaataaatacaaacataacattttaaaagatacataaagtcaagtccccctttaagattttttcaggtcaggtgcaagggctcacatctgtaatcccagcactttgggaagccaaggtgggcaaatcacttgagcccagaagttcgataccagctggggcaacatggcaaaacttcgtctacataaaaatacaaaaattagctaggcatggtgatgtatgactgtaatcttagctacttgggaggctgagacaggaggatcacttgagccgggaggtagagtttgcagtgaacagagatggcggcactgcactccagcctgggaagcagagcaagactctgtctcaaaaaagaagttagattcaacaaaaattaaattaaatttaaattatttgatcaattgctataaaagtttctaaacacttgctctcagttttgtaggtagctcatcaagcactgccagtgaccagttggtggagtggccccactgtggttctgctctgagtgatgtatgcacagaagcctcttctgcctaatggcttttgaatcctctgcaggattagcactgctggaatgttgtttgtctcacacccttacctctgagagctgagggcagtcgattcctggctattcttatttgtcacgggtgcctgtgtacttcctgggggaagacccagccctcttctaacccaggtcacagaaactcaaaagctgttactcaggtcttttatttttttgactccaaaaaaaaactccaaaaaaaaactggagtttttttccctaatgtggatgagtaggcaaagcttcccccaggcttaccccattttcttcccaggaagtttcttctaccacctgcacatttataaacaaacttgaggcctcacaaaggcaaggtctccctttttgccccttcaagcctttacaacaatctttattgcttgtcctgtgaaaaatgatagagggtcccttggcttcagaacctccctcaggctcatgccctccttaccaagtgctgggtcatacctggattcctcttcaagcctgcaaatactacatcttgtgacaagcacagtacatcatgggctcagaagacaaaacacccatcacaggttcctctcaccctccaaagtttagaatgaggccacatgtgtgcgtgcacacacatacacacacaatcttatttgtaaataagtattcctaagtcaccttagggagaatataggcccagatgaaaccagttggcggttcttgcatgtttcctatatattacaaaccatggatgaaattggctcatttccagattggcacagctctctacaaagggccagatgggtctaggtcacatttggaaattcattttgactattgtaagtgagcagcgttggagcaggtccacaaaataagactatgcaaatagataggtgaaggctaatggggctcgagctatttaagaatgtgcagcctaaaagcatcctccatgggcctcagagttctttccttggctccccataagctgccaggttgttctgcagtgttttgcatgtcagcattactattattttttattagagacagggtctcactctgtcacccaagctggagtgcaaggacacgatcacagcttactacagccttgaactcctgggcttaagggatccttctgcctcaacctctcatgtagttaggactacaggctcatgccaccatgcgcagctaacttttttttttttttttttctggagagatgaggtcttgctgtgttgcccaggctagtctctaactcctggcgtcaggcagtccttccacctcagccacccaaagtgctggcattacaggcatgaaccaccgtgcctgtccaaaatttatttatactcaggaagtaaacagagagtcaggctttgatcttcacttcttccatactggctattctccccttatctatagatgctgggtgctaggaagggcgttatgatggtgagaggtgtcaaataacctggtgctcagataacctaagtgccttgatccagaggaggaggcctttgaacgctaactagcttgtgaacatcaggagcatcaccagacaagacacctggggatacaccagccagcagcgcaaactccaaaccccaatccctgtatacaggcagggtttccttgtctctcctgataaccctctgcctatttaatatgttagtgtttactaaaaggtaaatgggaacattttaaatgtgggagaaggaacagactctagatacaccttgtgtcaaaatttactccttcaggtgggtctcagtgatatttcagtagccagtgtgagcaggatgacaggagccagctgtgcacatctcttctcaagtctgtattccatcatgccatgttagtaccttgtaattggccatcatgggagtgtccataccatggaatgggtaaatgctacaaatcagagctacttggccttttaaaagaaaaaaaaaattgagagctagttgttgaatattaccagcacagcactggtcaaccttaagacagcagattgcctggtcctatgaggttgtccagctggaagtttccgtgttgtccaggaatacagagtccatagccacaggtgagaatctgtgaaggctttacaaagggtggtcttacaactcatttggaaagagaggttgatgtcagtgaaaacattgactctcacaaactggacagaaatgaatactgtatctctgccattgaaagttcagtcagggccaggagcggtggctcacgcctgtaatcccagcactttgggaggctgaggagggcggatcacgaggtcaagagatcaagaccatcctggctaacatggtgaaaccccgtctgtactaaaaatgcaaaaaaaaaaattagccgggcgtggtggcaggtgcctgtagtcccagctactcgggaggctgaggcaggagaatggtgtgaacccgggaggcggagcttgcagtgagccgagattgcgccactgcactccagcctgggcgacagagcgtgtctccatctcaaaaaaataaaacataaaataaaataaaataaaataaaataaaagttcagtcagactgcaggtttttatacatttgttctaatcactttcaagtcaggagaattagttttcacttagttatgagttgacttattttcattttaaaatccaaataacatatatttattgcagaaaaatcaagggaaagaaaggaaatataaattacccatatttccactactcaatgatagtcatagttaacattttaatgtatacttttagagaaaattttctatgcttaattatttttctaatgaaagtgaatatattatacattgtgttttatactttttttacttgacaatatctaatgaacacttgcctttgccaataagttgaatatacaagaacgtatttagttgttgcaaagcatgccaaatcataggtcaaccaaaatttatttttaaaatctactgtttctggaatttcatgttatttcttctttttcactaaacagtgacagtattactagagtttaactatgtctttgagcacatccgaattattttcctaggataaatttgggctagaatgaaatttatttaacccaagaaaagatatttactaaaaaaatctagaggaacaccatactttctgaggaaagataaaagatatttccttaaacagaagataagaatggtgattactaccattcttaatcacttttaattgtaattcctagttaagccaataaaacagaaagaaagaaaaaagaaagaaagaaagaaaaagaaagagagaaagaaagaaaaagagagaaagagagggagggaggaaggaagggtcacaaaaatcagaaagcaaaaaaaatgactattattcacagaagaggttattttacatgtagaatatctaagaaaatattttttaaaaaccataggaaataacagaattcaagaaggtcaatgaatacaagttaaatacactatacagaaactcggtggtattctttttaaaacagcaagaactaactagaaaatgtattaggaaaaaaaatctattcttcatagcgactcaggttactagtttgagtaacctggtgccattaatcaaatacaggagtcagttacaggttctggagcaaaatgattttagataaaatcatcatagataaatatgcaatgaccaatgaagttgtatatagatcatggccccaatattattaaatgagcacgtgtgcatgtgcacacacacacacacacacacacacacacgatgggaagaaaatatatataaataagaatatgaactatctctggataatgtgactaagacatttattttactttattagactgttctatatttttggactcctcgattagtatgtattacttttatcatgaggaaaaaaatgtgtttaataaaaatacaatatttaaaaaaaagcaagtcagtggttacctggggctaggagagggaattgctcaggaaggagtgcaaaataacttttggggtaatggaaatgttctatattgactgtggtggttgcatctgtatattttttcatcaaaactcaatgaactatgtacaacacacttaaaaacatggccaggcacagtggctcacgtctgcaatcccagtaccttgggaggccaagatcacttgaggtcaagagttcaagaccagcttggccaacatggcaaaaccccatctccactaaaaatacaataattagctgggcgctgtggtgggcgcccgtaatcccagctactcaggagaccaaggcaggagaattgcttgaacctgggaggtggaggttgcagtgagctgagatcccaccactgcactccagcctgggtgacagaataagaccgtctcaaaacaaaaaaaaaaaaaaacaaaaaaaacacaatgtggtacatgtttattatatataatcatgcctcaatatagttgattcaaactaaaattttaaatttatatagaaaaaccaggggatctgtctgattcctgtcctactggcatcatcatgatgaactactgccttgatttggaaaaataagatctgcccaaatcctggctttctttggtggtggctactttttcaaccatctctgaagcagttgagaattctgggctccattttaaagtgggaaaaactgagatcctaagaaatagaaaggaatttcccaggaatttcaccagagtgcaaaaataggaactaattcccaggggtccattcagtgtcttgagtccctgccctgatgttcagttcattcacacatttactgaacacctactatgtgctagacactatgtctcagactgggaatgtaacacctggcctttgatcaacctacagggtagagtcaggtctctggaacggaagcaaaagaaataagtaccatgcactcactcacatgaacctgtagaatcctcctgggggatgatggatttccagagaactctggcatcttgccacaacccactaagttgtctcaggcaaaattgtagtagaaacctaggctctttgtacaagactctgtctacatgataaaaagcaccagattgaaaaatgatcaattccctgctctcgacagtcggaacaaaagaacaagactaactataggctttgcctgatttatcttgagcagggattgtacttcttttgtgtaataggtggtgtgcagtggccatggagtgctgggtttgggattggaaaacccagaaggcaagtgagtttgccacctcttccccatgtgcccgtgtgctgactcctttatcctctctgagctggcttcctcaccctcaatatgggatgacatgtactgtgcctactctcagaactcaaaagagataatcgtgtgaaaagacttgacaaaagtctaaagtaggagttggcaaactacagcctggataaataaagttttactgaaactacagccacacttatctgtctggtattgtccgtggctgctttcgcattacaacagcggagttgagtcattgccacggagttcttaggggccacaagcctaaaatatttactatgctgtccttcataggcaaagtttgctgagcactgctctaaagcactgtttaaccaggtagattgctgttgcagggctaggcacaggggtaagctccaagtaggaactcacagattaaaatgtggttggttgaatccatcattaagaatttatcttaatgaaacaattttatctctaattgattcgttgactttttaatagacccttaacatttacagttacaatcatgtctcaaaacacttgcaaatgtggcctgcagtttctctctgctaaagtttcacatctaatcccttatttagatgtgataacatcagacattcctgggcagttttcaggtggttctgtggttactgattacgaacaggaaaacagcatctctatgtacatatcatgacctgttcataaaagatgaaatgattttgtaatgttaatggtttgaaaggctttaaattgtttttcttttactgtttagacatctgtctgcatttagatcaagtttctaacagaaaaccccaagcatgattcttcatttattagagcagacatttgcctttcagtaaacaatgatgaatgtggcccaactatgagttcttgaaggcgagaatggtataggctttttaaaatctgtattcccagatgtgatcattcatgatatagtcacataataccatgaataaacagatgcttgataaatgctggccaattgactcactgacagaagggatggatgtttcttcacttggaaaatgtaaagaacaataaagcgtgccctcccctcccctcttatgaagctgaactgagataaaggaagttaaaaacttcctgtgaactgtcaatcacttggctgctcctctggtgtctgatcacattgctggggcctgatttaggttgagggagcctctttaacatccttcccctccaaaatgctcatccaggcttgccttagggctcctttcctgggtggtatgtgggatccacgtcaaagcaacctggggaagtaaaaccaaggtcagacctaaaagaaaaaacaagtctccaaagggaacatgcaccttgggagaaggtgggggagaagcggcaggaagtcccttaactggcaatgctggggtaggcgtcccctgggctgactgcatgcctctatggaggtctaagaacttggctgttggagctccctactcacccccagctgccccacttccatttgactttatgagacactgcatagtcacaaatctttgcagagaataagactccctggagcatgggtgtacaccttgagttgccacgacctggacacagctttccctgagcaaaggaacatccgctcggcctttgtggaagttgcaccctggcgtcgctcattgcagctgaaccaaatatgaggctagaaggaacttagtggtcatccaattcagtgcccccatgtactgacaggacctctgagcagttccagggagtcatggcctgcttggcctgactgttgggggagccctggggcatcatctcttctctccggcacaggcacaccctctttgtacagcctcctcctaaactatgacttcagtggagtcactctgttcccctccagctgccctgctctgacactttcaaccccaagaggtagcggcaccctagtctgagagtcatcccctactcttctttttctatccattcccacgcttttaaagagccaatccttctgattttttaaaacaaaatatcaaatgattctgaacatttgacaacacatttggacaggaaagacttttaaagcagatgtaaattcattcctttttttttttgcaggggcatttgcatcttcagagagtcatggaatttgagctagatgagcggtcagactgaggtagctcatctcctcctctgatcctgcatttgccataggactggccatttcacgtcacgccctcaaaaccacacagctcatggcctcaagtccaaatggccaggctcttggtgtgttagttcctttctgtgtacacaaacccccaccacacaccctctgctctgtccaaacttacaaaggagatgtcgcttcctcctgaccccctctacctcaaatctccctcatccttcaaagctcagggcaaatgtccctcctctccagagccttccctggaaacctcttgtcttctccttgtggggctttcctgcccttcactcacactcatgaactggggagagaatgctggttaacagccccctcctctcccaagcccactcctgggctggaagacttggccggtcattttaggctctgattaacgctactccagaagatcaaagtatgcagttaaaaacccaggcaaacttttggaaaaagtaagtcaattagaaacatcttaaaaaagaaaaaaaaaaaaaaaagaaactatttgacagtaaatactatagctaaacacatacaaactatatgatacaattccattcctggttattacccaacagaaatgcttaaatctatgcaccaaaagacatgtacaagaatactcacaacagaaatatgcaaaatatccccaaatgaaaactacccaaatgtccatgaacatggataaatattaataatagtgataaccatttatacaatgaaatacttcacagctctgaacaaacaagaattacatgctgcaatatgatgagattcacaaacaatattaagtagaaaaaatccagacacaaaaactctttgattccatttacataactttcaaaagtgacaaaaccaatctatatgttagaaattagcttagtggttacccttgaggtcgagcgatctatcaccaaaccaattataccactgatagttacatcaattccattccttttctactgcttgttttgatggtcaggagagagatttacaagggagtttgaaaagtgggagaatcaattcatttaaacaaggctttattgcatgcttccccatgggccaggcattgccctagatggtaggggtacaggatggattagacagaatttctgccctcgaggaagtcacagtccaacgaccaggctcacactctagaaagggccctcactcttcagcatgaggtgcccactctgtgaaatggccagtacctaactcatccaagaattctccccctagaaagtcaaagacacccctcaccctatcaggcctggaagatgtacccaggctgaaacacttaggtaccacccaccaaaacattgtcaccctgtgcctccataggagagggttataagctgaactgagagccgactacctcgctctggagtcctccagagctttgaggagtgatttccagtgcccataggccagcagaccactcagacaagggcaatttcgagatttctaatctaggcaagggccgtgccaagcaccacactgacagctatcatttgaggcaatatttcactcttatagtgtggtcaccgtcccagtgtgtttttcacatctaatttcatacaggaagtcagcccagcctcactgcttatcagaacagagaacagtcggcctccttgactctgaggatcccataaggcctcagtgataagctggctgcccccagattccttctcatcaggaggctcaggagacaactgggatggcctatgttctgggaaatgacagcacctagcagcatcagtaactctaccaaatgacttcgagagaaaccagagctggagggacctcagaaattacccaggcccaaagatactcccatctttttttttaaatgaggagattggggccaaagggctgaagtctattcctcaaggtcacactaataagtgatggcaaaactgaggacaaaattgaaatctccagactccagggttttttctgtatacactcacctgcaaagctcaaaccaggagaagcaaataccatcctctcaccttctaaacccagaccctgtagagtctcatagggcctctgggctaacttggacccacccttggaactaaagaaatttacctgcacaggagattttgcttctttaagcgcctgggcaagctctaatcccggtgcagtcagaagcatgcagcctgaaaccacctcttatatatgggtcctttctacacatggtgtttagccaagaatttgcgaccccacctcccaggaccttggttcctccccactgtgtgttctctggaagggagtggagtacccagggctttgcgactggattacacaaatccaattatttctttagaacaccatacagagaaagcctgtttcagtaatgccttaatgagagagagttagtcatcttctcacttccaaccctggggagggtactttcaggtgtgacctagaaaagcatttcactgcaggagcacatgatactgcttgctcacctccccacaactcccaggacaccaaagaaccaagacagagattcctgtacatccctatgtttaaactaacattgacagaagcctggaaagtattttcaagaggtggctgtgggttttcttttatggttgtcagagtctgaggcagccctcagggatgtttcctgctaaggaggaaatctgtgattcatttgtgctattgagatcgctccctcttccttcccaacctactttccaaatcccccattttggccatctgggactcagaacattgacctcccactggttgtctcctcacagttcaccttgggtcccgttgctccaaatctggttgttcttcccttaaagcatttcttagccctcctgtggttgctctagacttcttcactccctccccacccccacccccaaatccttctcctaggttcccaccaccacttgcacagatttccatcatagcagcttagttggttccagcttgcctgcctccacgcttgcacacctaggatccccagaacccagaaccatgcctagtacccaggaggtgctcaatatgtgtcagtggaatcagagtcccttgcctgtggaaatcctctgtcctcttcctccccgcctgcttcttggcctctgccttgactctaatctctccaactcaatcattttgtgtgattatcactccacccattttattagtactgataaattaactaatattgataataatagccaacacgttttgagcacttatgacatgccaagcacaatgctaagcacattgcatgcagaatctcatggaatcttcacaactttgtgaggtagtgctattattatccacattctacaaaaagaaaacggaggcacagcatggcaactcgcccaagataaccgcagccagtaaacagcagagatggggctaaagtcccagggtgtcaggttccactaacttctcctcatctttgtcaaggaattgtctccctgccactgtcaaatcaaatccaaagctttcttcctgagctaaacgctctttggagccttccccctgcctcatgtgccaaatagccacccttcctcgcatgggtctgaaggtgttatgaggatagcagaagcagtggatctgggaagaccattattattattatctatctcccagacataaccttttcattttcatctcctcatcctggcccttagttatcttcccccttctattcatcatcttttcagggactccaggtggggggcttccgctcatcccttgggacagcaccctgcacctggcacagggttaggctcactctatgtctaagttgttgttatggtcaccactgggcttaccataaattgtgctgcggattcacagagccaccgagacgcatagggtaaggcccaagggccatttcctcccgtgacaactcttgaaagttattgtcctgggtgacaggaaacagatggccggggagccttgcacagcagcactgtggccttttaacatctcagaggtcatacatcccttccccaggcttccgactgtcacccaggacagactagtatgcctgagaaaaaggcagtgaaggcaagtgcatctggtgatgagccttctgtctctgcaaggcacaggcaatcctgacccacagtgggctgtggaccagaagtgggttggcaagtttgtgatttatgaccagaaatttactttcccgtggaaacaagattttaggagtggtgaagcctttcccagaaaggctttgatgggcttcacaagctcaggagcagtagaaccggagcacttgctagagttctaagtcctggaggcaaagaagagggaaatgcattcctcggctggtggcacagtggagtattggagaatgagggttggcttgaaagtcagaaacacagatgtaggttcactaactttgtgaagctgggcaagccatttcctctttctgggactcaatcatgtgaaacacagttgtgctcgtcatctctctactttctgttacaacatattatgattctgtttgggaccagccttgagcaaacattcaaaggaggtcaaatgcgtctgtggcaccttctaatgtcctacttcccacttcttctagaagagtccaagtgccctaaataatctgcctctcccacaaacctaattgctctctaaagtttctccttcctttccctctaatcaaaattctcattccttcagggcacgggaaagcaatcaaattgaattcctgatgtctcactactgtgtgaatagcttccaagtccttaacctcaccataatatttgcattttttaaaatagagaactccttttccaaatgaatccctgattgttggaatttggggcactgaaataagaagtaaaaaaatccagttgaggaataaaatagagtactgagatagtaaataatgactgctccaaggtgacccttcatgggcacacaggttatttatggggtttcattagactcacgttaaggaacaagtaaaactgttttgtatccaacacaactgtaaataagaaaaactactgaaatgcctatggctaagctctaaccattgattctccctttgccaacataagagtaaagcgagaaagtcatggggtagcattaccctggccagggttacttctggcagccccacagacaggggatgtcaggctgtggtggctgcagcagcaccaaagcttcataaaactaactgacggccaggcatggtggctcacgcctgtaatcccaacactttgggaggccgaggcaggcggatcacgaggtcaggagaccaacatgaccaacagcctgaccaacatggtgaaaccccaactctactaaaactgcacaaattagctgggtgtggtggcacacatctgtaatcccagctactcaggaggctgaggtgggagaatcgcttgaaccagggaggcagaggttgcagtgagccaagatcacgccactaactgacaagtcatgctattccttgatgtttttttccacctgatttttgttcgtttggttatacattttcaaaaccaggatccaacaaggagaagagaagggctttgatttgtgagtgggagaaaagacaataacaagttcagaagaatgaaaggaaaaattgatgattccatatataactttcaagcattagaaatttatccaagaaccgagataataaaaagaggctttgtggggtagctcataaatgaaaagtcatcgccaaggtttcaaagtaaattccaagacctaagttattaaatccttcacattcacaatatttttagaatgtcacagaaaaatattcgttaagaaattcactatgaagtttgaaaaataaacacagacaagctattttctcaacagaagggtgttttcctaagttatcagagagctaattaaaatttcaagaacatttattcataacaaataatttgagtgaattctgattgacaaggactgctctgtctggggagggcttggggacagggctgtgagccatgccaatcagggaggcaaggcaggtacagtgcatgtttcttattttctgcctctattttaattgtgtacttggcattgtttaatgggtccaaatcaatacactactaaggaacatatttctaaccattctcttcttgaccctttctttgttcctgatatcattttctccaagtgtctcacagttttacctgtgttcatctgcctttttggggtttggtttttttttggtttacttttggctttgttttccttctgacttgtaaactacctatctttcttggcagaaaatgtatttgtatttgccattatgatgctcatgacagggaacactgatcgccagggagaacagcgtggtttctgcatttccttccgagagacggttgcaaggcttctgtttcatgtcattggggtatagtcggaaagaagccctggtggtaaataaaccatgactaatttcaaggatacaaaagtgaataagacattgcgactgatgcccagaagatgcaagaaaagagggacaaagtgccttgaagtcagcagcaccccagccagagtgagggctctagcacagttgccaatgtagcagccccaattcctgggagtttttcacacacaaccctctgaagcactgtgtctagcatggatgcctcaggtctgccagtcaaaggaattcctcaccttaacaactatgtcaaatagccatcctaaggcttgcattatcttaaaatagagggattctctatgtacagaaaataacacacttttatggagttgtgtgggcaaaagttttcaatagaacatggaagagacttatgttgaaatgaattttcctcctacagttccaaggaaaggtttatctgtgcctttcaaagcataaaagaccaaacttcccctcaactgaaaagcatgatatctagtaagtctttgagtctgggctttttcgaaagaggaagcagctctgaaaacattagtcgcttaggtggccttcatacctgggcctcccgaacacatagcaaccttcactttgacctgccctctctggaattatgtggagtttgcatcctagaaagagcttacgtttggagtcagatcagcctgcagtttgaccctgatgctactgcttactagttggatagcctcaagatagcaactcacctctaagagcctcagtgttatcatccacaaaatgggaatgatagatactttacatgattagtggaaaaattcaattgtttgttttgtaatgaatataaaacatttagtccaggggctggtacataatatgcactcaatacattttttgaaaatcataattgtgattattcactaatgattggatttggtgcttactgagaggtttttgagaaccttttaaccccttggactaggtgtgattggtctacaggatatccaagtgaaagtgtcagaaaaagatctggagttcaaagatgttacggagtgaatgtttgcgacctcccaaaattcacaggtggaaatcctgacccccagtgtgatcacattcggagatggagccttgtggaggtacttagatcatgagggtggagcaatgaatgggatttatgaatcggagttatgaatgggattagggctcttataaaagggaccccagagaactctcctgccaactttccgccatgtgaggatacaacaagaagttggcaacaagcaacctggaagaagactttcaccagaacccagctatgctggtgccgtgatctcgggcttccaacctccagagcagccagaaataaatgtctattgtttataagccacccaatctacagcattttgtcctagcagcctaaactgactaagacaaaaggagaagtgtaaactggagacaggaatgtttaaggttatcagcatgcagatgcagaaagaaacggaaatcttgcaagtgggcaataccacggtactaaattgattatctttggctcaccctctatccagagttttcaccagcccatgtgacagcacttcaaatgtaactttcaaatttttagctccttaaattattcacacagcacagtttagggtgaccagttccctcactgttaaatatgtcccatcagaccccatctggagcacatcagtcagttcaacatcctacccttcagaaagacagtgacacctcccctactctgcctcattttaagtactaagcttctgtttctttttctttttcttttcttttttttttttttttgagatggagtcccaggctggagtgcagtgggacaatctcggctcactgcagcctccgcctcctaggttcaagcaattctcctgcttcagcctcccaagtagctgggactacagacgcccaccacgacgcgtggctaattttttgtatttttagtagagatgaggtttcactatgttggccaggctggtctcgaactcctgacctcgtgatccacctgccttggccacccaaagtactgagattacaggcatgagccaccaagcctggccgcttctgtttctttatctgggagaataatgacattttgagctgtcactgtgcaaatgaaatgaagtcatctatgtaagaatacttagcataacacctgacatataacaggctctccatcaatgttgatagtcattttttcctatgtttgttttcatacagcctgaatcccatcgtcatttttcgcaactacatctcagtattgatccacgttgagtgtgtcatcagttaaatctcttgtctctttaacatgtgaattccgtcccatcctgtaaaggaaaagccttttgagaagagactggggcagtgctttagtattcttgtggctatcaatagagaactcctcaaactgactgcttgctcctgagactcttctacggtctcagcttccattgatggcaccaccatctacccaggctcccaggaaagaacactcagtacataacacacatatacatttacatatgaaggcttctatacacatacaaatatatatgtctgttaaagctgagaagatactacacactagatgctttgctttggtagaatattttttttatccagccaaaaggaaaaaataagtgttcaaagagatcatcatgcccaagccaaggggtgaagaagttgaggtggggagagaaaaaagaatccagacaggtaccaggatatcattgaaatcatgaacaaaacaagaatgctcacatctttgttgttttcaacactgttctgaaaattgtagccaaaatatgaaatatacattataaaccaacatagtattaataaaaaagaaaagcactggttgataatctttatgtaagtagaaaaacaaagaataaactaaaattaataaatagtaaataaaataactatatatattgtttaaattaatgggattcctatatataacaataaccagttagaaggtaccataatagaaatatttcatttgtaataataataaactataaaatatctgagaataatcaaggaatgtttttgacctatttgaggagaactataaaaagtttatagagatataaaagatttgtgaataaatagacagtcatgtcatattcctggagggaaagattaagtattaaaaatatgtcattcctaaaattaattcacagttttaatgagattctgattaagagatcccaatgattcggttttgtaggagagagaagacaaggagaaggtaattggcgaaacattaaaattaacttggattagacacagacaaaagattaataaatgtccttactgtaaaaattaaaaactctttcaaaacaatacgaaaaacactaaatgcttttagaaaaataagggaaaaaatagacaatcagaaaaatataaatggttcataaacaatttcaaaactttttcataataaaatatatactgatttttaaaagtctatcatttctcacttcccaaattgatggatattttaaaataataagttttaaatttttaaatgagagataactacattttaataaaatgaaaatattttaaaataataacatacagggctggagtgagagaaaaaaatgtaggaactctgatatcattgtggtaagtatataaattgatgtgccttttttggaaagcaatttggtgataagtatcaaaagcattaataatattcccaataatttcatttattaaatatatacaaagaaaataaaaccatggatgaatatttacatacaaaaatgttcatctttcaatgatgatcacagaaacagaatagataactctgaaatagagcttttattattgttgacaataattttgcaaatgacttatctgtccattattgaatatagttaattagattacagaatttccatatggctgaatattagcattcatttcaatttaattattggaatattttttcaggatatgtaaaaacactggtggtatggtgttgactgggggaaaagatcagatggtaagttaaatataagtgcacaaaagaaaagattgaagcaaaattacccccaaattttcataattacttttcaactggaaaaaataaaagacagaaagggagaggaggaggaagacaatgatgaaaataagaagaaagtgagaatatctaagaaattttaaaaacatactagtaagggagggcgactattcataccagatattaaaatttatcaaaagttgttgtaatttaaatggcataatactaatttaggcaaataactcatggaaacaaaatagataactctgaaataaggattgtgttatctaataatttataataatttatctttaagatttgacaaatcaaaggagaacagaagatcattgaaccgagagaactagtaaagaatgcggaaataattcctgatacattatcaccccaaactttaataccccactttgtctgcctgtgtatttttaaatatcccacgctcataggttctgcctttatcaggttctctgtgctcacagacatttttgtagtcatagacttatctgttataacatataaggttataataattggccaactacaggtaattcacatttctaatctttgtttgcttgtcaaaagccacatcaggaatgagtcaacttcagtgcctgcaccagccctgtgcagggttaaaagagagcttttctcctcaaggtgcttcctctatctcccctggcaaagagacagacatgtaaacaacacttacagcccgggaaagatgctcaggaactggtgctggtcctggggtccttcagcatggatttttctgcttttggtgtttcccttacccaagcgaggctgttgagtgggatggtgcaatcaagatcctgctggcagggacagacagatatatttgggtttggaactaataacttgtttctgtttttgcactgatcaagcagctcagagcccagtgtgatggctgctcacctctgggggcctcctgctcatctccctctgatatttctgtaccattcacctgcccattcccctcatatcagctgcctcaagggttcatttattttttagaattcaagggatttcggtaagctgcctcccactttttgtggactgaggggaaagtgagtaggatgatagatagctcaatcaaagatgcctgtgtgggcagtttcctacctctctgcacctgagtttccctctgggaaacatccctatcttcctcttcaggattgccatgaggactagatgcccacgctctggaaacacctgtgctacaaaagcagacactgaccataattaggagattttcgaattatagctcacatcttgcaggtagcaaatgtcttgcctttggaagttgaggttcttagaagcaggcatcttattaaaaccagatacacaccgctgcctctcgtggtgtgggctttcctccgtgtaatattggatttctcaggttagctctgctcctgctgcacccagggatgaaactgactttctgccaaggagagctgctatgtatgagacagccgcattccagcaattaagtagctgtggtaccgatggtatgaatggggagtgttattcctggacagcccatcaactagactcagacagaccctctttcttcatctcctttttggcttataaacttcctaagcacagttccctcacctgtgtatttttattctagacttccctttccttgtgcacgttcagtactcattcatccaaggggaaagggaactatttattgagcgcttactatagacttataaaaacgtatcaggtccttgacctacattgtttcattttatccccacaacaacattgtgaagcgtcattggcacttttctgcctttggtgtttctcttaccctggtttcactgatgaggaccttgtcataaaaagaggttttaactcggcctgatctcatcagtaggaattggctgagctgatgcactttcgcctccaactgaagtaaacagaatgagtacagcactgcgtcaggctgaagacgtgccctgtctagttggaaggcaaacaatttaaacatgtaattatagtaacatgtgatgaatgcggtaacagaggtttacgtggggtagcttggaagtggggagaggggcacagccttcttatgggagagctgctgactcagctcttcagagggcggaccaccacactgagccttaaggtatgagtgggtgcccaccaggcagagggtggggaagggaagactgaggctgaagacagggtgtgcaaaggagcccgcgtggtgaggagcaggaagcagctgtgggaggcacgcatgcgtgcatggttgtaggcaggtcaccaggatgcaatggtagttgggccaggttgaaaggggccatagattcctaagattatggacacttggtcccacttcccaattcttctaactcccctagccagggctcaaacttgtattccaggttgctgctacagtttccatcttctccctttacttctggccagactctggtgttgtggatgagaaagggaagtgtctgtatccacaccaccctgaatgcacccgatctcatctgatcttggaagctaaggagggttcggcctgagttagtatctgagtgggagaaacagaagagatggaaaagtcttctgtttcatagtgtcacccctaagaacccagagcaaacaccacagatatcactactaaaaattatattcctttgagtcaatgagccatcctcagttaagacacaaatgaagtgaaagaagttgctcactaacttattaggtgccagcatattaaatagcttattaaatattacagctattaaatactaagcttattcaatagtttattaaacagcttcttaaataggatataaggcagtgccatgtagtggataaaagtaataatcattataatattaagaactaatacatactgaacactttcaatggcactttacatgcacggtccctttaatcctgaaaaaatgctattgccatctttatttcagagaccagggtgctaaggcttgagagtgaagccactttccccaagctcacacagcaaagacacggggacaccaggactccatctactgcaggttgtctgactgggaacccccatgcacctggcaggtgacagaaataggaggcatgtgctgggtttggaagagacacctggtgggagagggccctgtggagccagatggggctgaaaacaaatgttgaatgcaagaaaagtcgagttccaggggcattacatgcagcaggatatgctttttagaaaaagtccaaaaacactaaacttcaacaatatgttcttttggcttgcatttgtgtataaccgtaattaaaaagcaaggggacaacacacagtagattcaggataggggtcccctctagaaagaaggagaaggggcaggagacaggatggggaggagcacataagtagatgtaaattgctgctaatttttctagtccttggtttgaatgataggttcatcaagggtccattacaaaaacatgtgttaagttttttaaaaatataataaaggagccaggtgtagtttgtcttgaaccacagttatgaaaaaaattccaactttgtgcatccaaggaccagattttttttaaaataaaggataaaaggaataagaaatgaacagccaagtattcactatcaaatttgaggaataatagcctggccaacatggtgaaactccatctctactaaaaatacaaaaattagccaggtgtggtggctcatgcctgtagtcccagctacttgcgaggctgaggcaggctgagaatctcttgaacccaggaagtagaggttgcagtaggccaagatggcgccactgcactccagcctgggtgacagagcaagaccctatgtccaaaaaaaaaaaaaaaaaaaaggaaaagaaaaagaaagaaaacagtgtatatatagtatatagctgaagctccctgtgtacccatccccaattccatttcccttttttgtcccagagaacaccccattcctgactagtgttttatgttcctttgcttctctttttaaaaacttcaatgcacacatatgcatccatgaacaacagatagtggtttttgcatgacctgaaacattaatgaaattgtatgattctatgcataatagcctacttctggctttattcactcaacaccatattttggcataggtagcaccacttccctcatttttctcatctgtagagtatgtattttttgtaactttcattttaggttcgggggtacatgtgaaggtttgttatataggtaaactagtgtcatggaggtctgttgtacagatgatttcatcacccaggtgttaagtctagtaaccaatagttcttgctttttgttcctctccttcctcccaccctccaccctcaactagaccccagtgtggtatatattttatatgaatgtggcacatttatccatttactcggtgaaggacatttagttgtttataaatttttgctgctacaaataatgttgccatcaacattcttaagacttatctccctatgcacatgtgcaagagtttctctagatcacgccttgaaatagaatggaaggagataggtcataggacatgcacatcttcagcttcactaagcaatgccaaactgtttcccaaagtatttgtgccagcctgcacgcccatcagcattttatgagagctcccattgctctacatcctcaccaaccctaccatccaactttttattcttgccattttggtgggtatggagtgttagtgtggtttggcatttctctaattactaatgagatgcaacatgttttcttgcgtttatagggcattcatgtagcctcttgtaaaagacatttttgtagctcttgccaagtttttttctattggaatgtttgtctttgttatcgatgcacagccattagttctatattctggatgtgctttcatgggtttttgtgtataggaaatatcttttcactcacttttgtatttttagttgaacgaaagttttaaattttgctagtgctaaacttagtttttttcatttttcagtttgtgcttctgacgtcttgtttaaagaactcttcctgactttgtggtgatatatatgcaatctctattgcaacttctgtatatgtcaggcttccaaatttcctggctatttactgtgttgttattctgttggtctctgtgccaaaaccatattaaccactgtaactccataacaatgtccactagggcaagtcctcttcgcttagttgttgccattgctatgttactgttgtcctcttctcttctctgttctcctttttctgccctccttccccttccacctctccctctcctcctccttattcttcttatcttctttcttctcctggaatatctaagcttttttttactattgctctataagttatacattttagaatcaccttgtcaatttccatggaaaaccttatttagattttgatttcaatcatatctctcaattattgaatttatcaatcatgttgtaaagaattcacatgtttgtgacaaggaatccttccacaatggaacatggcatgtctctcccatttacttagaacttctttaacatctttctataaagttttattatttttcacataaagatcttgcatatcttttgtcagatttatccgtaagtttttgttcttttgaacacagtatcttttttgaatattatctttcatgaccttttattgctagtctatagaaatgctccattagttccttttttaaacagatagatttcaactactcaagactgagacgggagtagatgtgtcaacacgcacttggtaaattagatattcggaacagacattcagcagtagacaatggcatggccgtactgattacaaaattcttgaaatacttccataatggggccccttgatttctttcctgtcacgctggccatactgacctctctccggggacaggctcagatctctccaaggtccagacgccactgtattaacaccaggcgtggcacggggccgcaagccttgctccactaggaaggccagtgtctgttccgggtgtttgattctcatgccttgtgagttgttaaatatctttaatattactccttaggttcgtatgttggtagtagctaaacaccaagggtgaaatattaatctgagtgaattctcaacaagagatgatcagttttggggttcaaggagggagtcgggagatctgagatgtaactaaggagattctattcagcactggcctctgataatcccccctcccctgaaatccctgcagcttcaccacactcctcttgaagctcctgcaggcacttcaaacgcaacacgttttagattgaacacattatctctgtctgctaaatcagctctctctctgcctcccctaattagtggaagagcttctccaatgatcttatcccctatggtagaaaattcaaaatcatcctagactgtgcctcacccttatgtcctcttttttttatcacataccaagatctgacaattctattccatgaaaaaaatcttttgagtctgacctcttctccaatcccattgcagctgtctcctaagttttggaatagtttcctaaatggtctcttggcctctgtattcgtctgttttcacactgctgtgaagaaatacctaagactgggtaatttataaaggaaaaaggtttaattaactcacagttctgcatgcctagagaggcctcaggaaacttacagtcatggcataaagggaagcaaacacgtccttcataaggcggcaggagagagaagtatgaggaaccaagtgggaagagccccttataaaaccatcagctctcacgagaactcactcactatcatgagaacagcatgaatgaaactgtccctatgatccaatctcctcccaccagctctctccctaaacgcatggggattatggggattacaattagagatgagatttatgcggggacacaaagcaaaaccatatcaacccccaacctcttttgcccctccaacactgctcttggcattccagttcctgcctggtccatagcctactccttcttcatctgtggaagggagggtagtgggagtcattagcctgggcagggaggagtgttttatcactacactgtttagaatggtgccaatacaaagcacatcaactttcagcaagtttattattgggtttaaattctctacacacgatgcactgcttttgcctacacctggacagtgttcccactcactctccttagtatgatgctggagataatatgatctgccatgaaggttaaataaagcaatgttcactgagaacttagcccaggcccctgcacatgctgagcattttgttaatgtaacaatgattagtaatagcattgctattggttccccatctctggcaaagcctttcatgcttggcctccctcactctctttcaccttcctaaaccctacactccagctatgccaaactgtttactctgccttggacacaccaagttcctcaagcctttgcaaatactccttacgctcctagaacaatggatgtcaattcatcatttaggatccagcttacagtcatgctttccatgaagccttcctcaaattagccacacaaaaggagtgactcctccctgtattcccatgaccctctgctcatgcctcctctttaaagcctgccttcactggagttcctggaagggagagtctgttcagcactcatctctgtatccacagtcaccaaaattgtaactgccccataataaattcccaatacttgcagggattttgcttcttggcttgttttgttttgctggaatgaatgaataagtaaatgggaacgattttgacttcaccctaagcctagctaaaagtttgggtagtgacagttttggttattttgtgtaacctgatagtggatcccctttctatgccaaaaaaaaaaaaaatcccccaatactagagtacctgttttcctagggaattgacctcagcaactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccttcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagtctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcgggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatggaagggatattggcattgtctcatccagttgctgagtttgcaggtgagataaccgaggcgcagagaagttaaatgaattgtgcagagccatctaaagagtgggcagcagacctgggatgttaagtcctagatgcatgtgaggagatgcttggctaaacgcctgtaactctgagaatgagtcatccattcccttcaattacagaatccttgggctggagggaggctcaagaagtcaatttgttcaccctgcattcagagaagtccaccagaggcccttcttatctttagagaacaggcttcactccagtcctcaatcttcccaacttcaaggccagccattttcttggccccttttatagccattccaaattgttgagaatgctgtggccctctgtcttaagactcaggctcccacagcttgagaatggagtttggtggccccccaaagtcaagtgtgctcatctcctgcagagggtttggaaagcaggggtacccttattcctattccttggctgtttgagcatccacagcatgtgaaatgctgtgctttgtttggtgaggagtgcagaaaagttaacagtctagttactaattttctaggtactaattttctctaacatccaccttgtaacgccagccttctggaagtagcaccatgctaataggtcatgtctaaacacaacaccacattgagtttgtccttgtggagtgcacagcctagggctcagcagctttaagaggccaagtgatttctgaaggagtttgggaggtgatgggcctgttggctcttgtatgttttatattgatagaactgcaagaggccttagagattaaactaatccattgcttcttaactttctatctttagaaaaatgtacgtacatcccaaatttgcatataatgttgggggtccaagggccttctttggactttagggtgggaacccctgatctaagccatgcttcttgttttattaagcacccattgctgccaaaggcacttcagagctgcctgggttgcctgcagagtttcctttgtgagccctggcctccacttggcccattcatgcctcaggggaagttcaggccatttgcagatggcccttgccctctcagccttccctggctctctacacatatggtatttataacctttcatacattatctgtagcttctccttcctggtgtacaatcattgacaagacaacatccatgccttagcatctctggggccttgcccagggtctcggctataggaggttcccagtagacattttgcagaatgggagggaagatggggagaggtgaggatccccaagcagcagacaggtttgagcgccttttgtctgagacactctcccggctttgcctaagtcatcactggctgttaactgggtctaagaaagtggcagagtcaaattgccacagatgattcctcatctgagggagacagtaagaccgggagaggcagatcgctcttctttcttatcctccatgtgcagtagttccctctccccactcatgtcagcaactgaatttagctcatgcgtcaaaagctgtctccccttgagggagtgtcagccagcgctgtaggaggggtcataccacagggaaccctccagaaccaaatcatgtacttttcttctttctcataaaatccagtaaacagttgtttttaattggaaaatatagaaaagaataaatttaaagaagaaaaaaagtcacccataatcccatgacttaggagaagctattttaatttacatataaaatatatttatatataaagcatataatttatatataaatatatttccagtatttgtagctattttatagcacagttgagatcatgctatacatataattttgtatgctggcttgtttatttttgtttttgtttttgagatggagtctcactgtgtcacccaggctggagtacaatggcacaatctcggctcagtgcaacctccgcctcctgtgttcaagcagttctcctgcctcagcctcccaagtagctggggttacgggcacccgccaacacgcctggccaatttttgtattttaagtagagatggggttttgccatgttaggcagactggtcttgaactcctgacctcaggggatccacccacctcagcctcccaaagtgctggggattacagacgtgaaccactgcgtctggccagtttttcttacttatagcatgaacatttcctatgttataagcgttatttgtcagcattatttttaacaactgcatactatttcactatttgtatatacaattattcattcaactaatgaatagcattgtttttaacagctgcatactattccattgtgtgtatatacgattcttcacttaatctacttctcttggatgttttaggctatttctaattttttgttattgtagaataattctgaatatctctgtgtataatattttttcctatattgtgtgtgtgtgttttttttgtttgtttttgtttttgtttttttgagattcccagaagtggaattgctaggccaaaggttgggcagggttttgtttaaaatattttttaactttaaaatttttgtactaagagtcatattttgcagttgttttccgagagggtgagttgacactgcatcccttccccattgcgagtaaggctgctctggggtggataagtgcgtccatgcctaggtctcagaaggcctcctcctctcccttctcccatccctgcttcttgccttgattcttgtctccatgccaggcctgaacctgtgaggggccttttcctcagaaacaaagatttgcctctttattcccccagttcttggcgttttgcccctgagggtccatccactttcagtaatatgtgcttgccacagcgtctatttcttgtctgaggaagaacacacagaaaaggacattcttttaataactagttaatgtgctgtgatctctgcctgaaataacttccccggcctaaggcccggcaacacagagtaataaaatgaacagtaaattggcttggcggctgccctctccaacacaggctgcctctttggagtacagtagctctgtgtccctctggccctggcagcctttcctcctgcctctgctattcttctccctttgctatttctctgcccggcatgcagccttgaatccctccttccttggaccatctggcccctggtcactccttctcgctgcctacttctgtggccccttattctgcaggtagtggaggtgagtagctggctgctccaggggctgaggaaggcctgagtacttccatgggccatgagggaggcctccctggaccttggcagagctgagagagaggctctagtggattggctgtggggcctggggctgcagagctaagctgccccgggctccttggggaggctgggctggtctggagggttgcacggaccttctatcgtgtgacttggactcttgaggcatgagcacttggtagggctgctgggatgggagtccatcgtgagggctactgagctggccctttcagcttctcccacttcaggagactctgcaacctcccaccccaaaggtgccttcgcatttgctgtggccgcaccagctctcatcaccaccctgacatccccaccccaggcattacagcgccactgcgccgggaaagatggttctccagaaagccaaagggatagagtgagagggccaccaccccagtagacccactcactgcaaagtccatcctggcaggcatagcccctgcaccaccttcagccctgtccacccaccaaggccaggggatgtcctttgtctgatagggttctgatctgctgggtctctaaaggggcctgggtgaaaatccacctgcttcttacaaggcctaagtgttacacaaggaagcagaaggccttaggccagaggaactgtgtccgcgtgcctcggcctggcttaggggctgccttgaaagtcaggtgcctggcagtcatcaggcaaaacatttactgggaggagaaagacctttggggaaaggtctccctcccattcccattgacagtgggacgaaggccatggaacacagtccaagtcagcagaatccagctccaccacttcctgcccagggacctggttaggaaggtctgacagaggtcaggccacctcccctttctgacccgcagtttccttatccataagatgcgaatagtaataaccgcctcacagcattactgaccggattcggggtggggagggggaggcagaaccagtttagcaccagctgtgctccaggcaccgcgcatggggctttatcatttcctctcctctctcgagctgactctaacaggagacttagaggcaggctctcaggaaggtgcgggaaggcccttctccagcacgaaggggagggctggagaaggggcacgtcgctgagctctggggacggtgccgggtagtgccctgggcgggctggcctgtcgcaaggaggctggactgtctggccaccagattctccttcgtgctggaatcccttcatcacatggctgagggtgctttcgacagggccaattatagctgctccagggaacacggagctgactcatgcctcaacttggccgtggagagtctcccatccactttctcgcttgtgtctgtgggatgcgttacagactccctcaaaccccatgaggccgacagggcaagtattatcatcctggactcagtctgtcctgtctcccctcattcttgtgcatccccgtctctgctgttcccaccctggcctgaattaacttttcttttttcacactgctgtgggaatgttttctcctggcaacagaggcaatctgtatcgcttcccataaagaatcagtgcatgagattcctcaatagatttttcctttctggacacagtggtggctttgttacaggggcacctgctgctgtaagccatacccaaatgtccctgagaatttaccccacccgactgtgctgcctggacttgctggtggcctcattagactcagtgtttccccagacccatgtgtggtcagcaagttttgggtcatgtgggtttagcaggacaaactctaggcccttgcctgaccacctcgggctgcagccctgtaacttccccggaagccaccctgctaggctgggaagccttcactcatctgctgagaacaccacgtccctctcaggggtagaatttgagacgcctgtgtgagaaggatccttcattgctgctgtttggccctgttcattctgggcatttttgaggctgcctcagaatggttcttttcagccctctctatttcagctgtccctggagcctttgatgatccctacttcccgcaatccactgttgctgctcccttgcagagccctgcttagggcttctcatccacacactcactaggtcaggtgcctgggcaggcaaagatagatggggtttcccaatcagggtggaatctttctcgtgaagggtaatcttggccgactgtttgtaaatccaaaagtgtccttttagagcccatggagccagggacctgctctgatcatatgatagcagcagctttgggatgccacaccccagtcactgaggccaagcagggaaccccacagctgatatttacagagatgagtacactcctgcgtttgtgggcctcaaagcctcacctctcctccaaggcctggccctgcctgcctcctgccaaaccatatttctttgtggccttcttgtcccattcatcgttctaaaagggagctcaacccttttggcctgtccctaaagatggctgcatttcctggtcaaggcaggaaaggtgagtgtagtggttaggagcgtgaactcaaatccaagggccaggttcaaatcctaaccctgttactgtttactgagtgcatcacctggggcacctttatctcctcctccttcaaatggaatgataatctaggtaatttaaggtactggttaaatgcttaacttctgcaatgaatttaatccccagaactccctgtgagataggttttcttattaggtccatttgatgaggaagagcatagtgctgatatcatagtatgtgggaaggtgaaacgagataatccatggaaaatttagaacaacgtccggcacatcgcaggtactcagtcagtctgaacgattacccgccatgttatggagtgaggtactgaggttccctgagttaagtaccccctgaagagcatagccctcaatgttagagaaagcaggttggctggccccaggccactgagattcacagcttctcccaggaggccctgaaggagaaggtattctgagaaggcaggaagtgctagccaagggtgcagctgttaggattcactctcatcacaacctcggtgccagctttcaaagtgatcctctgaccaggggaaatcctgccctctcactctgattattgaactgggatctggagagatgaggggcttcccaagacaacctgaaacccatctgtgccctgtgtggcgggtggcctttggacaggagggctccaactctcagcagatcagcagcttcctccagggctggctgccgaggctcctccttggggacggagcccacagcaacctgactttaactaccatggaactgcagagtaaattcacagctcagaacgctgctcaaaggcacaaatgggatgttgatgagtgggaggaagccctggcaagcctccctggccaccacccctctgtgcagaccaggcctgctgctgcagtccacctgtgcacattacaacatccttcatggttacaaagcatgcacacgttgtggggaggggtgtgtgtgtgggtgttgggtacagaaggaaggcattgacagatagaaggtaactttttgacacctgtttaggtagtgcaggtaaaacaccaaacacatttaaaaacatagcacaattataatctttatctgggaatcccaccatatactattacattcgtaatgaaattgcctaatacccaagggcacaagggaggactcatttgctgaacatacctattttgccaggtactatacaaggcattttgaatgtagtctcttctttgaaagttggaattaaatggataatgacaagaaagatagaatgaaaggtgtgcaggttgcttctatgctaaaaaataagatcaggtggctgggtatggtggctcatgcctgtaatcccagcactttgggataggccgaggcaggtggatcacctgaggtcgggagttcgagaccagcctggccaacatggtgaaaccccgtatctactaaaaatacaaaaaattagccgggcgtggtggcggctgcctgtaatcccagctactcgggaggctgaggcagaagcatcacttgaacctgggaggcggaggttgcagtgagctgagatcatgccattgcactctagcctgggcaacaagagtgaaactccgtctcaaataataaataaataaataaataaataaaatcaggtcaggcacaatgcctcacacctgtaatcccagcactttgagaggccaaggcaggcggatcacctgacgtcagcagctcaagaccagattggccaatatggggaagccccgtctttacaaaaatacaaaaaaattagccaggcatggtggcaggcacctgtaattccagctacttcagaggctgaggcaggagtctcacttgaacctgggaggtggaggttgtggtgagctaagaacacgccactacactccagcctgggcgacggaatgacactccatgtcagcaagataaataaataagatcataaatgtgtagatctgcatgaacacttaataacatagtacttgtgtgcatgggacatttctggaagaatacaggatacaaaatacagatactagagggtaggataggatggagattcatttttctttctttctttctttctttctttctttctttctttctttttttttttttgagacagagtttcgttcttgttgcccaggctgtagtgcaatggtgtgatcttggctcactgcgacctctgcctcccgggttcaaatgattctcctgcctcagcctccctagtagctgggattacaggcacctgccaccatgcccagctaatttttgtatttttagtagagacaggtttcaccatgttggccaggctggtcttgaactcctgaccttgtgatctgcccaccttggcctcccaaagtgctgggattataggcgtgagccaccgcgcctggccagagattcatttttcatagtgtaccttttatattgtttgtattttgtatcatatatgagctatttttatattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaagttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggtgagtgtggagggaacacaacactttcaggtgctctcttttcttcttggggtatggggagtgaaagaacagtaggcagggtcttgggatgcttggtgcctagagtctcctgtcaatctttccatacctagattgtcccttgcttgctgagagtgtaactgagtcagttgtgagatgcagcagctgcaaatgctgggttgattcctccttatcagggagcagggaaggatacaacaatgactcaggtcacattcccctaccctgcacctacccctagtaaaagtggaggaggatgctccatatagttcccagtatttgcctaaatattcagtggctgggatttgcatccaactggaaggaggcagacgaaggttcttttctattcacggatattgtttctacctggtgggaagaaccctggaattaagagggaagccttgggtttgagcactaactcttctactaaattgaatgaccttgcacaggtcacctctcttcccccgggacaagttcagccttgcagataccaagatcatcatgatgatgtgaatggagaaagctctaggaatgcttggcaaactaatctgggccttcacattaattattctgtttaaccagaatgcaggctgatcc

SEQ ID NO: 557 - DNA, 43573 bp, Homo sapiens
acatcttctctacttttttcacaattaaacacatgaggaatcagtgatctccaattggctaatttcctactatcttctaattttaaaaatgaaattctaatggcagaagttaatagagcacttaattagttacataaacaaacattgccagtaaaatgtcattgctggaatttaacttttttttttttttttgaggtcttactctgttgcccaggctggagtgcagtggtgtgatcatagctcaccatagcctcaagaaatgtttatgctttagctgatttatgatacagttggtattggaaaagacagtttgagactttagcattggaaaaggcagattaaaacttgaacgttaggttgtttgcatctttacggctatgttaagcattgtgtccaactaagccatccgtctttagtaatgttaatatttgattagaaatattttattttatactgctagtaagagtgtaaactgagaagaccagttggtaagtacaagtgctatttttgggctgtggatttgctggagtgtgtattcttagtcatgtgctttcagtgaaaactcaagactcagtctttaggctggctttacttttggcaagtatttgatgattctccacagtgattggtaccaaatctttcatatccctggaatctagcccgcagggagagtatagtgctatccattcattttagaggaagttggaggaatagaaagaagctgacagagttgttggcttcaaatcctgcctcttcagtcaggcctcagttttgacagaggttttggtgattatgcatagtcacagcatctttatactccatgagggagtatgaaagtgtctgagtctatggtctgtgtgaacatctaattgcaagggtgcatacatgtgagagagctagcgagcagtaagtgtgcaggggtgagagggagcatggtgtgtgtggaagtaaatctatcctcttgaatgtcccgatgtttcacaaaaggatgcagttgacaaaatgtgtctctgttggttctctggagctgacagtcttgtggagggatgtgtatttgagctaggtgtccagagagggctgcattcaaggtggtatgggagcaggtgggaggccaatccaggggacagttgaggtttcaggcaaggcctgaaaggaggaggtctaggctgatataatgtgaaaaataagcaagagttagaaagggaagaaacagtgttagttctagagaaagaaagctgtaattttaaaggttaaagtgtgaaaggagagctagtaataataggaggtaatctgggggattcatattgtcccttttccacattctcaaataaatgcatcgcatcaaattttaatagcagcttgaaaatattttttcacctacttgttttatgttaaatggaacaaaaataattaggaaaaagaggggctagtgtttgcagtttttcaactttctttttgtaaaaatagaattgtaaaactctttaaacctagcttaaggtttgcagttgcttgattgttctgtgattggaactatattttgtttgatgcattgttctttggcataatagtgactgtttttgtccttaaaaaaaagcctctctaagtcaatgttaactatcatatcttgagacacaaggcttgtatttcttagaatcctattctttatctattcactgtaaagccattctaaattggtctccttttcattcacagatctaacgagagatgatcaggatcaggatcaactgagttttgagctatgtgtttaggcagtaatcatgggtaaaacccattgatgataatactgcatgatgtttaatatttttcaagcatttccctttagatttgtatcttttacatgagaaagcctgcactcagaaagttaagtggtatagctatagttggttagttttcatgttttgcttagagtaaaacattttaagagcagatcctgcaacacaaagatctgaatacagaaggagttatttcgattttattctgacattctgaaacttagcccaaggaatttacagcagttttgaagcttaacagtagaatagaataataacaacaatatcaacaagaataacacctgcttacctcctatatgccaagtacatgcattatctatttagtgcttacacaaacattatgagatagacataccacttatgacagctgagagctttgaatttatgtcatactcttgcaatggatgctaggaaatgttttgtttgcttgagtacattactacaccatataattgaggttctattagcaaagaaggaggaggaggaggaaagatatttgtcagtagcctgtagcctctgctgtattagtcacccaccattaagtctttcctattttattaaaggacatcttctcaaatttctcatgcttaggagtcttctatttcatcttaacatagttttatgaaaataggtatattttctaaaacaaagtaaatttagtgataagagtgcattgttctactttaaaaaaaatctctttgatctctggcctgataaaatataggtattctcgtatctgcattacattcactctgttgtgatgtgttgtgttttggttgaagtgtatgaaaaaaatctggcctcttagagatctatagttgaaaagggaggataattttagaaagtttttgaataattatggatattcttctctgatttgcccccaaattcaacgaataataggttctttaaagttagatataatgtagaatttgaaaccattgaaatgaacttttatttcactgctgcattaaaatctattggtctgtccttcactttaaatgtatctttttctcatgcatggttttgtaacatcatgtattgcttatttggaaaacaattatctactgagttatacagatcttccaaatgctgacatatttcattttaaaataccaaaacgtaatgctaacatcatcactgatcttatcaggaatgccttgggaatctgttaagcacacagtgacggtcataagtttacaaaaattatttcatttgcaactcaaattttgtcattggcaataaatactgtcaggtgttttccatgaagtgatagattcatgtcattaatgtttgaggtaatatctgacaaatagtcaggtctgtatgactctatatgttttcccatcatactttcaactaaaatggtgttttatgaaaaatttagctactttaccttgcaatgtaaagtactttttcatgaggcaaccatggtactttggaatgcagcatcagcgcttcatgcattcttcctgtttctttatagattattaaaaatttgtgtgttcagggtcaagattttataaacttcataagctttactgtttatcaaggacatttttaagttaaactacatttttgtttctttttgtactgagagtgcatgatggtggagaatataatgactactaatatagtctggtgccatagccttgattcacatgatggcaccagcagttttatcccattgtttttgcatcaccagtgcaaacgtcaacagaatgaaaaagacaaatatggttttaatattattataaaactttaaatacaaaataaaatgtataaatttgacacatacaaaaagtaaaataaattgtatcttgatgggggatggcagacagtactttaaaattgctgatataggatttgaattatcacctagaaggagaagttgtatgggtgtgttttgtatgggtgtgttatgtatgtgtgtgagtactgttgtctctcagtatccacaggcattggtttcaggataccccactggtaccaaaatccaaggatgctcaagtcccttatataaaatgccatagtatttgcatataacctatgcacatccttgtgcatgctttaaatcattgctagattacttataatatgtaatacaaaggaaatgccatgtaaatatttgttatacctctttgcacagtgcctggtgcatggcaagttatcattatattttggcttttcatttgcagccacagtgaaaaacttggctcccttgtcagctcgctcattcaatttttcaataaatgtttatcagccgtctttcatttgccaatcagtgtgctaaaagaacaaaatcaaaaattgtgctcacttttcagaaacttatcttcttttgcggataaaaagatagtaattaaaatgcacaaatattcgtgtaaaattgaaaccctgacaagtgcaaatagagatatatcagatgctttgaactagccagatatgtgaaagaaggcttccctggggagagagtgactttcaagctgatatctgaaggatgtgaagaattacccagggcaaggtggggagagagagagtgtgttattcccttttgtgctgttataacagaatactacagactgggtaatttataaacaatagaagtttatttggtccatgttctggaagctgggaagtccaaggttggggaccacgtctggtgagccccttcttgctgtgtcataacatggtggaaggcatcacttggtgagagagcatgcacacatgagatggcctaactttctttcataacaaatccattcttgctattacaaatctattcctgtgataacagtgctaattcatttatgaaggcagagcactcatgacctaatcacctcttaaagggcctacctctcaacattgttgcattgcagattgtttctgacacataaactttgggagacaaattcaatccatagcagagagcattccttacagaggaataattgtgtgttaaggcccctcaaagagggagaatggaactgaaagaaggtataaggatctgaaaggagactagtgggccagacttaagagcgtgaaagggtgaggttggagaggttggttggttttagttaattttaaagaattttattgtttgccaaaggcaaaaaactcatatcaagaatgaccccatcttatactagcaaagctatgacccataaatctgctttttaaaataaaataaaattataaataaaataaagctttcttacaaaccagtgtttattttcacatacagcctcgttttaaccaatgtacagatcaaaactcaaaatattcctctgcagaaaactttggactttattccctagctgacctataatggttgaatttctgtcaagtataaatttatgtatataatgggcttaattatttaagagaataactgagggatttgtgtgatctttgaaaaggaattggactgtcatacttgggttgtgaaaaagctatacaaatggtagattttttaaatttttttttgacttatacaattgctttattttattattttttacttataagaacaagcatttatttctcacagttctgggtgctatgaagtctaagatcatggtactgaactcagtgtctggtaagggcttgtttcctggctcattaatgccatcttcttactgtgtcttcacatgatggaagagggaaagcagctctctggaatctctttaataagggctctaatcccattcataagagctctgcaccatgagcacattcagactacagcacctgaaatacttagtgttttttggctttgtagacacatcattctgatttctgcttttatcttcacactgccttcttctgtgcctctgttccctcttcttttcttaggaggacatccatcattggatttagggcccaccttaaatccagtataacttcatctctagatcattaactaattacatctgtaaagactacatttccaaattaggtttcagtctgaggtttgagatggacatgaattttggtgtaggagagacattagtcaacccctacaataggtcaatatcaagtttccatataataaagtgtcttgttctgggctctctgttcagtttcattcgccagtttttctatcgtatttctaaaattatggtcactaacttgaacttaaagtgctaacattttatgtggttcccattgtgatattttctccaaaaaaaatatataggaagtttttgacttaaatatatcttagggctttttcaagttggaaccactagaaaataagaatttcagttctgtatttaacttttttagtgtcataaacttacttgaacatgtattttagtgcaaacgactaaatgcattaccattacggagctatctgtatgtcgggaaagtactctggcctgtgtagaaactggtagtgttctatatacaagctgtctggtttgatttcaggaaaataaggtgagagaatatgaaatctcatgtggtgagaactaaaacatatgaatggacaccctattgggtatttaactctcagtggttttgtggttataggttgataaccacattgatcagagttaagtttatttctcagtaattgagattgtattttacacatcagtattttatgcttttcctgttataggcagttttaggtaagacttcttttggagtctgttttaaacaatttagctccgaatcatcttgtatcttttcttctagtattttttctttgaattttttaattcattcaattcctattttttccttacacagacttttgaatatgttctgatcagtggctaatttaacatgtttttctctttcttatttaatttaggggaaaaagtcaataagcatatagactactctttccaaatgagtgaggtaagttaaatatatatgcattaacttccttataagtcagaataaaaaatcaagataaggttaactaagcctttgtacttatttacttataatacattctattatgccctctaatttattcattttttaagtagctaaagcaagttccatgttccatgcagatttaatattggatcttttctagatgttataagggaacaaatagatctttgatttgttttgaggctccctgtgaaataaactcagatatgctgatcattgatatgcaagatactagtatttggcttaacattttgctataatataatgttagtgtagtctgtgatagcttattattttacagttattagtatgattagtgcttatctatgactatactggagttcaacctgaattgcataaacacattaaatagaataataaataaattaaatactacttgtaaaaatacagaattcttttaaccaaaggacttcttatataaattttaagaaccatacaaacaatttatattgcttctatactgaatataagcatgttaaaggcatttcaatgaaatcatttttctgatagactctagttgataaagaatcccatgcatagctctcacagaggtagacgtccttgagtggtttcaggatgtcctgccagatataaacaggatttaaaaagaatttccaggaatgattgaaatttctgcttggaaaacacgtccttctagaataggttggctatttgctagttggctggataagctcattaagattcctagaagttacagggttcctttaaaagttcagtgacccactagtcagaatggctattgttaaaaaaatcaagaaataacagatgctggtgaggctgtggagaagaaggaatgcttatacactgttggtgggagtgtacattagttcaggcattgtggaagatggtgtggcaattcctcaaagacctaaagatagaaataccattcgacccagcaatcccattactgggtatatgcccaaaggaatacaaatcattcttttttaaagacccatgcatgtatatgttcattgtagcactattcacaatagcaaagacatggaatcaacctaaatgcccatcaatgatagattggataaagaaaatgtgatacatatatatcataaaatactatggagccataaaaatgacaagatcatgtccttggcagaaacatggatggagttggaggcccattacctttagcaaactaatacaagaacagaaaaccaaataccccatgttctcacttataagttggagataaattatcagaacacacagatacatagagggaaacatcacacgctggggccttttggaggatggagggtgggaggagggagaggatcaggaaaaacaactagtgggtattaggcttaatacctggatgatgaaataatctgtacaacaagcccacatgacataagtttatgtatgcaacaaacctgcacttgtatctctggacttaaactaaaagttaacaaagaaaagttcagcgacctaaatgctgagagaaacagaatatgagaaccagagggaactatgaagatcatataggacagtgattttatagtgtagtttgcagatcaatatacaaacaagaataagaattatatgaagaatttcttaaaactgtagactcttgggcccaggctgtctcaaaataaaataaaataaaataaaataaaataaaataaataaaaggaaagtagagcaaaacaaccccaaagcaagtagaagaaggaaataataataaaagcaattgaaaaccagaaagtattagaaaaaatcattgaaaccaaaagctgtggaaagatacataaaattgacaaacctttagccagactggcagaaagggagttgcgctgggacatatgtaaccaatatcgggaataaagcaggacatatcaatatggaatttgtagataccaaaaagataataaaggaatactactaacaactctacacacataaatttgacaactaagatgaaacggaccaattcttcaagaagcacaaactactataatccactcaacgttaaaacaataatttgaatagccctgtagctactaagtaaactgaatgtgtaatttttaaattcccctgaaagacctcttcaggcttaaatggtctcattggagaattctaccaaatgtttaaagaagaattaacattaattttatacaatctcttccagaaaatagaagaaaaacagatgcttctcaattcatgtcggatccctacgtaactttgataccaaaagagacagacagtttaaaaaaaaatgaaaacaaaaaacctaaaagttggatccctcatgtacatagatacaaaaatccttagtaaaatattagcaaataaaattcagtaatataaaaataattatgcaacatggccaggtagggtttactctattgatggaaggctccattcatttttgtgtgcgtgtggaaagggacagagtcttgctctgtcacccaggctggagtgcagtggcacgatcttggctcactgcaacctccacctcccaggtttaagtgattccccttcctctcctgagtagctggaactacaggtgtatgccatcacacctggctaatatttataattttagtagagatgggggcttcaccacgttggtcaggctggtctcgaactcctgacctcaagtgatccgcctaccttggcctccctaggtgctgagattacaggcttgagctactgtgcctggtctccattcattttttgaaaaacaattggtatacttcaccaaaggctaaagaataaaaatcatgtgatttttatcagaaaaaatattgtcaaaatttaacttccatttattaaaaataaacacaaactctcagaaaaccaagaatagagaggaactattttaacctgataaggagcatccacacaacacttacactaacagtatatttaataataaaagactgaacactttcttcgtaagatcagaatgtcctcacttacccttctcattaaatatagtactgacagttcttgcaataagacaaaaaaataaaataaaaggtattcagatcagaaagggacaaataaaattctccccatttccaggtgacatgacgatgtacatagaaaatcccaagaaatctacaaaattaaagacaaaaacaaaatttcctagaactgagtttaagaaggttgtaaaaaataagaaaattatatagaaattagttatatttctatatactggtaatgagaatgtggaaacccaaattggtatataagttaaaatatctgtatgacatttcatagacataggcaagattattcagaaaattttatggaaatacaaaggaagtagaagagataaaatgattgtgaaaaaaagaagaaagtgggagaaaaccctctatgttattttaagacttgttctttagctgcagtctaatgaagactgtgtgatatttggagaaggataggcatgtagattaatgaaacagaatagagatcccagaaatagcctcacacaagtacagccaaatgattttggacaaatgtgcaaaagcagttcaatggaacaaacaggctggagcatttgtatattcataggcaaacttatgaacttaacctaattttataacttatacaaaattaattcaacattgatcatggactaaatgtaaaatgtaaaactatacaattttttgaagaaaaaatggatcaaactgtttggaaattagatcttggtgaagggtttgtagttatgtcatatctgcaaacaaaaacattattaatgaaaagcattgataaattggagtttatcaaatgtaagaattattgttccctgaaagatcctgttatgatgatgaacagacaggctacagactgggataaatatttgcatattctgtatcagacaaagtacttgtatctatgatttataaagaacccataaaatttaaatattttacaagaaaaaatgcccagttagaaagtgggcaaaatacatattgagatctttcactaaagaggaaatatgatggcaaataagcatatgaaaagatcttcaatatcaccagccactaagaaatgcaaaataagatcaaagtgagatgtcagtatatgcctattagaagagctaaaatataaaatagtgacaatacaacttactagttaggatgcagagaaactagatctctcacacaatgctgggggaaacataaaatgatacagtcactctggaaaactgttgggcagtttcttaaaaatctaaattatgattttcatgtaagttgggtaatcatactcttgggcatttatccagcagaaatgtaaacatatattcatacgcaaaacctaaacacagatattcacagcagctttatttgtagtagccgaaagtggaaacaacctaagtgtcctacagcaggtgaatggttaaacaaagtgtggcacagccttatcatgtaaaactacccatcagtaaaaaggaacaaactattaataaacacaacttggatagatctccaggacattgtgctaagtggaaaaaaatcttaaaggaacacatatgttatgattccatttttatgacacttctgaaatgacagtatacagatggagaacaaattagtgatttctaagggacatggatgttgaggggaaggaaaatggacataaatttaaaagggtagcatgaggaagatccttgtggatggaatagctctataccttgacagggctggctcttacccaattgtacacacgtgacaaaatgacctccaactatacagagacattgtactcatgtcagcttcctgattatgatattttactgtggttatgtaagatggaaataaccattggaggagactgggtaggggttacatgggatctgtgtgtattattttggcaaattcctgtgaagctatagttattgcaaaataaaaagttaaaaaaagtgaatacaacttatttcactttcctcaatgctaaattatattttttctgacactcaaatgcaataaaaacaggctctacacattgcagtcaatttttttcaccccatctatgggcaggaggcaggcaattttcaaaaaaaataagtattatagcatattcattcaactattggattgaggcagaactagaatcaatggatttttatccagtaacaaatttatagatatgatgaatgtttttaggcttttacaagacagaagtataagaattgtaggttcattatttcaaaattattttatgtttgaaaaggtcttctgtgctttcatgattgcttaaatattaaaaagctattctagttttacctctgatttacaattagtatgagtccatcattggacattgttacagtcttgttggaaatcagaaaatgcatgtgaattaaacatgcatgacatgattaatatatttattacatgatcactagaaagtaacaaacattaattttaaaaagtcaacatttatggagaacttcccatgtattatttaatctcactgtatggactttatggtttggagaggttaacttgctcaagtttacaaatgtaatcagttttacatatgtatttaatggggtttatataattgaagaaaaaggttatgaggcaaactgaaactatataaattgttttattgttatgtctcctatgttttggagctgggattctgaacacaggtaatctgattctaaagctccttattcactgtataatatttctttaagaatgctgttttaagaattgtgtctagaagtacatcaaggattctcgttttgcctaagactattcttagtaagaaatgagacaatgacatactcagcaaaatgaagaagtaatctaagttattttattttacattctgcaaagtgaagatataaccccatcttttgattggaaatcagagcaaagatttttcctaaaaggagagattgtaaaatgactagcctggttgcttttgaatatatggttttcttctatgcttctgtaagcaaaacaactaacatttctctaggataattggaaaaacttatcaggagtcaatataaatgaaactataataaatttgtttattgtcttagcagaaatgtagctgcacagcatatttttagaggctactatttcagaattgagtgatcaagatactcattcacttcatttgctatctgttgtatttagacgagctagtggaattcattcaaggtccacaagtagatataatcacatataagtggattctaattataactgtattttaggcctgtatttactcacagattctcagtcttcccacaacttttcccaccggtttcagtattactttagtacaatagattgcattatcttgtaatttatattaaatatagtggtatgaaaattgtacattttcaaaattatctttcattctcttttaaagaacacagagaaattactgcttttgtggcacattctgttactttacttttgtagcattaggtatatttccaaggtgctctttgagtatgttgtaaatatgtctgttacacattttatctgctattttgaaaactgatttgcccagcattatttgggcataatgagatactgattgtgatttttccaagaacaaggtaagtgaattacaatctggacatgaatttccgatcatttctgttggttgatgtctctccatagtattatattgtacctgtcactagagactgctgagaagtcattgggtgttatctcaggtctgtgtcctgtggtgtgtggaccatcgtgtaacctaaggaattgggaatccaccatatacagagggaggcatccctattgtgttaattataagtggtttgtgtgtatttttatacatgtatggctttttttgaagaggttataaattcaaattattaagaatcctgatggtgtattttccaaggtattccctttaatgatttcaaacaaatgttgaagggcgtaaaatagccaattaattctgcctttcctgttggtcctcttcaggatgcagcatcataaaaagattagacctccttgttatttctcagtaatgtagtagttcttaaccacttcttgtatctgatttcttttatgatttgataaagctacctcccaaatactaattctctctgaagctcactctctttcctcactgcacagacaaacacaccctgccccacaggcacatttacagatacatagcacacatacatgaacacacatgcacatgcatacacatatatgcccacagttttgcatatgatttaatgtggttccagattaagtgtttctgcatagagattacagagttgttactgaaacttaaaagcaccctttgctccacctgcactattaataatagcattatatcttcccctggtactgttagcagagcctgagcagcagagagaccagctttctcatcaatgaagaaacaatggtaagcagcgaccagtactatcctttcttgcatggacacaaatggggcatctttttgtagtctgcaatgatgatactcttttccagttcagttatttgacatgctctcatacatggtatttgagaatatattactttagaaaaaaaaaatcagtttctttaggtggggggaaaacacatcagacatatcagtgagaatgacgcactgagtataacactttgcttggattttattttttctatgagaaaatgaagggtctaagaggtgtaatgacttgaccaaagttattgatatgtttaaggggttgatgcttgactacactcaagtttctgaggcttacttagttcagtattctttctccactgcatcactcttcttgtctttaagtacatgcctgaggataatcatgaaaaagtacaattcatttaaaaatcaaacttaaatatcaattaaaaggttggtaaggggacctgaaacttttcattagttgcctagcaagtaaaaaatgccttttgggaagatggggaaatagagttatattcctatactgataattttagcaaggatgatagtttgcttttcactagagtactaatctttagtgttttggaatgaggattgtgatattgatcaaattaaaacaattgaaatgttttgttttctttttaaatttatttttacttttttttttttactacataaagcattttacatgattccaaagttgaaatccacagatcaaataacatttagatgagcctaaagcttatacaattttgatatcactctttaagaaacatatggaaaaatattttcctttaaaacatttacgaaaatattttaccacgagaacacattgctggagtccttcctaaacccttggaaggggtagatgcaagtaagatgccctgaagattagactttattagcttgaaggtaaatctgtcttagcttgaaggtaaatctgtcttaggttgaaaatatgaaacaaagtgttttcagagaaatctttcttctttgtcctctcagtctttttgtataatagttagcatttttgtttggtttatttttccaatgctattacaaatgttgctaaaatgaatacccttgggaattagtcttataatattttggtcattttatttttctgcatggaattcatttatcagagaataaaggtatatatagtaatttgtaattttcccatatattgccaaattcccctgccttttgtgtttgtaacaaacctgtgaaagtggctgtttccccacaaccctatcagcagtgtgttgttatgcttttagattcttgcctgtctcatggtactgagatagataatggctattgggaggtatttcacttggcacagtatcttagtatcatttaaaattgcatttctcacaacatgtgtgagatattcatctttttctacattgagtggtcatttaaatttattttgctatgtcactctgttcatatatcttgtccatttcctgtcaggttttgtttttttttttactcttgatttttttggagctctttatatatatttattgttatctccttgcctgtacagaagttgcagatactttcctcaaatatgttaaatacatataatttaatttttaaattctaagtgactttaaaatgatgtatgatatttgattcactatgttgacattgtctttgattaaacagtaagttgttaaacagtagacttctttttaaaaatatactttattttaatatagttttagattttattataaatctatttattataaataaaatctaaacagagtttcttataccccacactgattttctcctattattagaatcttacattagtatggtacatttgtaacaattaatgaacctatattggtgcattattatcaaataaagttcatgctttatccagatttccttagttttcccctaagatccttttcctattccaatatctcattgaggatgcagcattgcacttagtagtcatgtctcctcaggctcctcttggttgggacagtttcatgtacttcttttgatttttatatccttcacagctttgaggagtactggtcaggtattttgtagaatgtccttaaattgggactttcctgatttttttttttatgattagacttggattatatgtttttggaggaagataatagaagtgtcgttatcttcatgtcatatcaagggtatattctatcaacatgacttaatcacccttaatgttttaaccttgattacctggcttgaagtaatgtttagcagatttattcactgtaaagttactcttttttttttctccctttccatactgcaatcttcagatgaaagtcactatttgcagcctacacaaaaggattgggattatgctctccctccttataggtgaatccattatttggaattgttttgtgtgtcggggagatctttcttcctttctttttgtcagtgtgtacttatggatatttattttatactttatgttataaaccaaatactactttattttcttgctcaaattgttctagctttggctattggaagtggtgttttgttttttgttttgttttgttttgttttgttttgggacagcatcttgctctgttgcccaggctggagtccagtggcatgatcatagttcactgcagccttagattccttggcccaagtaatcctctcaccttggcctccctgagattacaggagtacaccaccacatccagctaattattatcattattattattattttggaaattgggtctcactgtgttggtcaggctgctctcaaatttctgggctcaagcagtcctcccttctcagcttcctgagtggttggaattacaagacataagccacatcacttggctggaagcttttcagttgactcctgtgtttccttggtatacccctattattgtgtttagttttgttttgagtattttccttctttctgactagatgctccaaattcattttgtacatttcctgcctcagtcctagaatcaactgtgtacccagggaagtttggttttttttaaatatatcatagaaatatcacaaaagaaaaatctgtataaattagggtcctgttaggcctactcagtgtaggataatttgagaaggacttcttaaaaagactttttacaaagatggggtgtaagggaatctcagcatatataggtgtagtaatcttgaatttattaaaatccatagaactgaagggaatagggtaaggagaacttactggaacccagaaggaagaactcatatactatagacattatcaagaggctcaatgatctttggtgaggggacacaatcttcctgaattcaaccttaggaaggaaaacactatctattctttccaatcattcgtgagaagcaagaggtcaagggagctctttggttacctgcacaggacaaaaagcagggtagagaggagtggagagggaatgtgctgggataatccaacgtaatatcactggatatgtttttgggtaaaaaaatggagtcttgcggttcctactgtgattattatgacagaaactctatatcaattattttataaatatttaataatgcaatttaaaattctatttgaaacaaaatagtgaaaagtgaatgagtacctaaatgattacagagattgtcagtatagaaatgtcactaaagccactaaatgaaatacagaaagatggaaactattatgcttaagagaacctatcttagagtgactactgtaggggattggacagaatagtttggtaagtatttagagtttagtaagcaaagaatgggaattgaaaagacacactaaaggttgcttaaataacgacagatatgcaattaacagattttgaaggagtatgggccttgatcacctcaaggatgatattccaaatatttaataactgatatggcacaggcacaaaccaatcagaaggagtctttgagtaaaatgacaagaagcaattagtgtcatattagcacagtatttataattgatctgtgcatgtatttagatattatcaccttatgattcagtcattaattcagtctcctagtgatttcatccagtttcatggctttaaatacaattgatatgccatctcaattctcaaatttgagtttcaagtgtagtcctttctcctcaacttcacttttaaatatccaaatgctttctcagcatatgcatatggatgtctaaaagctatctcaagattaatatgtccaaaatgtaattctttatcttcccctgcaaaaaaactgcttgtctgaagtctttcgcatctcaacaacatgcattatattcttttcgttgctcacatcagaaatttatgaaaaaagttttcatcttcattggttctacattaaatacaataaaatgcacccattttaagtgtgtagtttgatgagttttaacaaactataatttatgtagaaaatttccattacctcaaaaatttccctttagcggttttcctcctaccatattctagcaaccgctgatttgtttttctttctaatgtaatatataaatggaattttacagtatacactattttgtatatggcttcttgctgcttttgctcgtcacaatgtttctaagactcatgcaaaactccaaatattactaataaattcattctttctgaatatatctgtactagagatattattgtttattttattgctcagtaatatttcattgtatggatatactgaaatttatttgtccactcatccattgatggatatttggatagttttcagtttcaagaccattatgaataaggctattatgaacattcatgtaagaagtgtttttagagatgtatgttttcattaatcttgggtaatttcctaggagtagaatttctgggtcatgtggaaaatataggtgtaactttatgtaaaactgtcacactatttttaaaagtggttgtaccattttttattcctgccagcaatgtacgagagttctttttgctgtacatcttcaccaacatttgatattgatattgatattgatagctttttaatttcagtaattctagtggataggtagtagtatcttgtgatttcaattctcatttcttttttaaataatgatgttgcccatcttttcatgggcatattggactttcatagatactcttttatgaactgttcaaatcttttctgcattttaaaaaaatgagttgattatctttgtattgacttgtaagagttgtttatgtattctggatgcgagaccattgtcaaccttacttattgtgaacattttcttccagtttgttgcttgccttttcgtttacatagtgtttttagaaaagcacatttagaagtatataaattcaatttctcatattttatcttttatcatccattctttttatgttctatttaagaaatatttgcctacaccaaagtaggggagattttctaagattttcttcagttttatagttttagtttttatgtttaggtctgtgatccatggaagtcataatgtggccctgcatggtcctttagtgtgggagtctttcatttttcttaacaattctttaatgaatttagggaaaacatctgagaaaaatagtaacctgtgaatctcatgaaagataccaagaaaataaaaacactgagatgaaaaatttcaggccatcagaataatataggttaaaatatattttatgtaatgaccaacatttgtcttgtatcttttgtattttaaaacaacagcaatactaactcctctgtctatatatagaagacattagtttacagggcaggaattttccctccaatagtcaccagttgcttagacttcttcagcctattccaggaagagactagtttaagtaattgtattggattatttatccatgcattacactataaaatacactcaattcttgctcatttatgctataggtttggttttctttcaaatatagttgagtatcccagatatttttaggtaattgaccctgtattttaaataatgaccatgtaattgaagattggagataactgagcatttgaataactgaatgactttttatgtattctattatattgcatgctcattaaattaaaaaaaaaacctgggtaaactttccatactacacatcatatcagtataaatgtggtaattttaatttcttttcctgatatatacaggcatacttaacaaaatatctattttactttatatttttattattttcatgttttcctttattattattatttttctcttctcttccttaattacatcctttgcagggacatggatgtagctggaggccattatccttagcaaactaacacaaaaacagaaaaccaaatactgcatgttctcactgataagtgggagataaatgatgagaacacatggactcatagaaggaaataacaaatgggatcttttggagggtggaggatgggaggagggagagaagcaggaaaaataacgactgggtactatgcttaataactgggtgatgaaataatctgtacaaccaatccccatgacacatatttccttatgtaacaaatctgcacttcctgcacatgtactcctgaacttaaaaaaaagtagaaataaataaaataaaatataaatccacaaatatttattatttttagtcactatttaaagaatttaggaaaatttacttgagtctccttattttctttacctgtttattgctttcttcccatttttcttctttttttccttgctaatttgtatcctccagtttgaaatatcacacacacacacacacacacacacttataaaatgatcataccaagggttagtttgtctttgtcttttttttggaatctttactgtaattctgggcaggaagtgctaattctttattggttgcttcacagcctgcaaagcgattcaatttgttcctgaggcggcggcttatggtaaaaccagtgctgaatgatgctgcttatgctctgaatggctgcagtggtagccttagttatttttcttctaatgaatactttgatttgggggaacattgtcactaattcctagtccccaggcaactgaagtttaagaatagtgattcttaatttgttctggatttggattaaatctatagatcctcttcctaaaatgtatgcacattctcacacatacacgtaattcatacagtttcagtggtttatgaactctcatcaggaatgcagggttttattttgttttgttttcacacagagtcttactctgtcgcccaggctggagtgcagtggtgcaattacagctcactgcagcctcaacctccctggatcaggtaatcctcccacctcagccttctgagtaactgggaccacaggggcacaccaccatgctcagctaatttttgtatttttaggagagatgagtggtttcaccatgttgtccaggctggtcttgaactcctgagctcaagcaatcatctctcctcggactctcaaagtgctgggattacaggcataaaccaccacacccagctggtaattcaggtgtttgaaccacagaataagtacatcctttacagagaagccactcagatgtttacataattacaaatagatattctaaggacaaatcaaatataaacataaacaaatgcacacacatgctacaaaatatatttatattatgttttgagcaaaacaaaagcatgatgtatgttagtaacattcagttatatgtgacagaattatcagatttttctgcctcaaccttaactgatttttattagtagtcctgagacatgtctctcatgctgacttacaaggctcccagtgatttttttcccatatttaaaacagatttacagtgtatcatcagggtgtgatataatgatagaaatttgtgttttcctagctagcctttggctttcagaaggacagtatgtatacctatttttgactgagcactccggaaaatcactggaattactattctcttagctactttgtctgttttcttgctgtcgaatactctgaatatgagttttgttaattcatacgtgcacatgttctgttaccagaactgttctttgtgtacccagatttagcttatgtaaacaatacaagtacctgtaaatatattagtttttgaaaacaaagcaaaaaacaacaaaaaacccctctatcatacaaaatatgactgtcacagacttagagaaagaggactatttttttcttttaatttttgagctttgattttatttagtctaagtagtatattatttctgcctcagttgccttccaagaattttggtgaatttcataagatgctaacgctgtgatgatttataagagtgccaatgatttgtttgggttttttctttcttttcaagttttagtgatttataatcaaagtatagtgtgatagcagtttgatttttctcaggttcttttactttcttttaggaaataggagatgattatgcatcctttggctgaggtgaagagaactcagacataacatttgagttactgtatcttggcacttaatctctaggttccctagatttttttttttttttttaattcttagttcccttttccacacatttcttcctgtgcattgggagctagttttttttctgagacacatcagctttgcatcagctatgtaaatgcacttactttgttcatagaccacagatcaaacatgagacttatggcttatttgcatataactgatcctcatccattcccttttctgggaggcctgtctcacctgacttgggtaaaaaaatcccatagggtacaataaaggaaactcatgaattaatagaaacactagttgtgaaaattaaaaccatatagttactcattcgcaggtgagctaaagcaattggaaaactatctaattgacagccactgtattatctatttgcataattctaagtgtaataatacatgtaggctagcaggaatattaagtattagatataaactttaaataaaaccaaatcagtcaaacatgaaatctctttcttctgaagctctctcatgtttttgctgtttttaaagtgaaggaactaatgaactaactacacaacacgtgaaagttgaacttgttaagtgtaattattatactgagataattcatgcaaatttaaaaaaggattgatttttgctcacctgggaaattgatgttgaagggcgagttgcatgaaacctaacttgtgatgccagctaataagctacctgctttataatatttaactgcaccttgattttattttaatccttacaaagttgaattaggaagtgacaattttataaaaacatagaataaacattaatcataagtttattttcttatagtgagactccattaattggtctgtaattaattatacccccaaagttgtgtgtagccatgaattatttagtggactaagtgatatcttgtttgatgaagggaacaagtcagtctctgaatgtgcattttgagatcaatttatacatatattcatttcatattttggtatgtttgcagcatttttgttgtatgtgcatgtagttaacatgcttatcttcctcctgagtcattattgcttaatcttttatatggaatttcactttataaaacaaagcataatctgttgctgaaaactctggttatttgtcttgatttgactaaattataaataattccttttgtgcttttgccatttcagaataaaactataatttacaattgtgtcatttatgtctcctgcagtttcaaaaaaatcagcaaagcaaagattctatcttcttccgagatgggattaggcaaattgattttgtgctttcctacgttgatgatgtaaagaaagacgcagagttaaaggcggtaagtgcattataacagaagtgggaataataaaaagaagcacattttataatttcacatggatatctggattgaattatgttgtaaaagtgagaggccctgaagtgttactgaaaactgaaactgaatgagataactgtaaagtaggcagcctaagaatagacatgtaaagtcaatgttatctttttggatattttgcatactaacttatttttcttcttcttccaagtaactgattctttttatagctcactttagatattaaatgtaacatccaaaatttgaggtatgtgtctgaatataataattaccttttgtatgatattttcattttggaaatgtatgactaatccattgctccaggtatagcttttatattgtactctattcctgattctattttatttgtattacacatcactttatgagcttatttattcatgtttttacttgtttgctgtctccaacactataaattaagtttatgaggccaagcactttgtcttgttcaccgttatgtacccaaatcctagaacaatggttggactataatggatactcaataaatactcaatatttgaaatcataaattaatccatttttatacacatatatgtgtgtgtgcatacacacacatttacttatgtacttacaacataaatgtcatataaaataaaaataaaaaatgaagatattattcccacaagactccatacatatacaggtctgtcccttttttccacccactgcctggaaagccttctaccaggcctctgaaattcatgacccatcatcattttcatctcttctccgaacattcccttcaaacctctttgaggttttttgctttccgtagcagtcctctcaagtgatgtttacttttctttatacaacatttccctagagatggggtaaatgctgcttgccttccttgtatcttgttgattatactgtgttctccttcacttgtccctgaaattcctgagatttaaatctcatcagatttattattatcctgcattgtttttgtcatttatctttctctgcatcttctattcctcaacaattttacctcctggatcactgtccgtctttccagcaatcttttaaaatcattgataatatcaattcatacttagatgattattttgacactctggcctctctgttccttgaactcccttttccaataatcttagcttctactcagccattcactcacctagaacttgtcactactaataactgcaactctttataatttcgttttacatgtacaactgtctgattatacctcaaatctttctgatccacattcttcctctttcaacctcaccaggaccagataagatgcaatcgtcttactgctttttgctgctcttattcccctctcactctttattcagcttatgtctcgtggtcaacaattttaattactctgttacatatcccgccaagtcccttgcccctctcccagttgtacttgacaaaataacaactttagttaaacccaaccctacctactaaatgccagcacacatgcagaaaggaaaacttacaatttactgactgactttaccttgtatttgtgcccatggaccttaactgggtccttatgctgtgtggcaatcatactttccttccatattctgttttctcccactttcttagatgactgttttataatgctttttctttcctcacacctccaacacctcctcctgtcttcaagcttagctgatcatatttttctgtttcattgagaaaactgaagcaagaagagaaaacctataaatttctaccatcacatctgtccatccaccaggagttttgcctgtgtaagctatcttactttctgttaccatagacaaactatttatccttctacctaaagccaactgctccacttgtgccctgcattctctttcttcttgcctactattcaggagtgccaaagacaaccctcaggtttaggggttcattagaaggaatcacaggactcagtatatagtcatgcttatggagacgttttattacagtgaaatgataaaaagcaaaacgagcaagggaaaaagcttatgggacaaagtctggaggaaaccaggagtaagcttgtgagaattccctctcagtagaatcacaggatatacacttactttttccagcaacaatgtatgaaaacacatgtgaaatatctattgggcaagcccattagagtgccctaggtttttattaggggctggttaccttgtcaccttctgcctagcacataccaaaatttcatactcccagaaggaaagcagatattcagcataaataacactgtttgtaaaaacagtataggcaaaatgagccactcttatcagttctgggagtggagggaactcttcagaaaagcaagtcccagacactaggaccaacctttctaaagttgcaggcaggcctttctaaggatagcaatttaatccctgctttattaactcttttctgtatacctattttgggatattgctctgaaaattagttcctctttctcctaaattatatttgatattctttactgggccattttcttccatgaataactaggctgttaatttttctatattaaaaaggtatgaataaaaaccctctttttgttccagttttcctattagctactatttctctattttttttcttttcaattatatattaaacctattcctttcaagcctttatcccaaccactctgcccatctccttgtataaaatccaatggtcaagcctcagccctcatcttacttgacctattagcaatatttaacacagttgatccttcccttttctattgtgtatgttcttcatgtggcttccaggactccacattatcttagtttttttcttatttcactagttgctccttctcagtctttacttctcctaaatcacttattattaaagtacctcagggcacagtccttaatcctcacctttccttatcttacactgatgtatttgatgattctgtcttacagttttaaaatcatatattttatgattttatatacattaatcatacaatcccagaattcatttttccagtccacatttctcttccaactgtgcataactaaatgactgttctgtatctcataccttcaataaggtactggcataacaacagacacacaggccaatgaaatagaatagagaatccagatttaaatctatgaatttaaaacaagttcatctttgacaaaggggccaagtgcatacaatggagaaaagataggcttttcaataaatgatgctgatgaaactggataactatatgtggaagaatgataccagatccatagttcttaccatacaaaagatcaaatcaaagtggcttaaagctttgactctaagacctgaaactatgaaactaccagaagaaaacactaaggaaatgctccaggacattggtgcagacagacttcttgtgtaagaccaggcaattaaaggaaaaatagaccactgggattaaatcaagccaaaaagcttctgcacagcaaaggaaaagtgcccattgttggatgaatagataaagaaaacgtggcaaatacataaaatggaatatttttcagccattgaaaaaatgaaatactatcatttgcagccatcgatggaactggaagccattatgttaagtgaaataaaccaagcacaaaaagacaaatgtcatatgttctcactcatgtgcaggaggtaaaaatgtggatctcatgaagatagagtagattggtggctaccagaagccaggaaagggaaggggaaggagggagataaagggggaaaaacaatataatgcatttattactactgaactatacacttaaaaatggtaaagatggtaagttatatatgtatattttaactcaataaaaatgttttaaaaagaaaaaatgcttttttttgtcatcaatacattgctttaataaaagctgggtgggtggttcacacctataatcccagtgctttggcaggctaaggcgggaggatgagttgaggccaggagttcaaggccagcctgggcagataatgagacacagtctctatgaaaaaattttttaaaaattatccgagtgtggagacaccttcttgtagtcccagctactcaggaggctagggaggatcacttgagcccaggagtgtgatgctataatgggctgtgatcacaacactgtactccagcccgggtgacagagtgagaccctgtcactacaaaacgaacaaacaaacaaatgaagaactaagcacccaagtggttattttcagtaatgacctatagttaaatgtaagtttactttttgctaagtgaagccattttgtccttcaggattaaaaagtcttgatgacatactggcttaaaattccattaaatgtatagtttatttgaagagtattgatctttgtaatagtgaatcttttcaacttggagcatatgtctctctgtttataaagtttttttataatttatgttattcagtaaagttttgtacatttcttcagatagaggctctgcatatttcctggtgattattcctggatatactgcatttttgtagttgtgaattatagtacaagagaaaagcagtacctgacattcagatggagcatttttatatacaaccatgggaggggcagagagccatccagagtcacagccattgtatattgaatctgtcaatactgagcaaataaaacaaaagcattctgcataattctgttgatttttttttgtcataggaaagaagaaaagagtttgaaactaatctcagaaaaacaggtcttgagttggaaatagaagacaaaagggtaaatgtagttgataatttatacaagcctctttaatttaagtgttgttttctcctactctggcctttgcctggatagactctgtgtttgggggcaatacaatagctcttttggctacagatatgtgcaccgggatgatagggcctgtggtcttacaggtaagtagatgagtactgtgaatatgcagtaataaatggaacactttataaattgacacagtttgcattcaggatacaaagagaaagaagatgtggactttttatcataacagtttcattttgaagtctgcctataatctggtaccctaaataattaaccaggctgtcttgcagcataacctgctgtttaagccaagacattctttctgttcatgaatctaccaaattttctttttaaagtcattttatttactgtttttctagaatttccttcaaaattgtttttaaaggcctatttaatatcttaccctatctattccagcctgggcaacatagcaagatcctgtctctacaaaaaataaaaaataaaaaattagttgggcatggtgcctgtagtccagctacctgagaggccaaagcaggaggattgctggagcccaggagtttcatggttgtgctgctgcactccagccttgccaacagagtgacgctctgtcttaaagaaaaagaaaagaaaaacagaagcattactctctagttctcccattttcagtgaactaataaattattataccacacaatccataatttctcctatgccatgaacctttgttacctaaagttcttcctcattgtgtaggctaaacaaagaagctgggtaagaagagtgagtacgttttacagtttatatgtatcacttatataacgtaagtaaaattttgagcttatagctagttactaaaaacttaagaaattgcccagaaccgcataggttattgtggatttagagatgagtatacattgaccatgaaatatatgtttaaaaatagtctttctctgcatgtgtctttgtatgtctctctttctgtctttcacatatatacacacattatatgtatacatatatacatgtttttgtaactatatgttttgtgaattttgttttctcaaagttttgcctgaaaatttcaaaatattgaaaatgctttgatgtgtttgagattttataaaatattatccatcttatttaatcagctcaataacaaactgatcagtaagctttctgctgttttgccttttttttaatgcaggactcggaagatggaagaacttattttgtcaagatccatgccccttgggaggtattagttacctatgctgaagtcttgggaatcaaaatgcctattaaggagagtgatattccccgccctaagcacactcctataagctatgtgcttggacctgtaagactcccactgagtgtgaagtatccccatcctgaatattttactgcacaattcagcagacatcggcaggagctcttcctcatcgaagatcaggcaaccttctttccatcctcatcaagaaacagaattgtaggtagagaagacctttgggcacatcccttcaaatacgagatgtatgcttgtgtgtgcttttatacatgtgcagatgtcgtaccatttctgcaaggtgcttctgtataggatataagcatttggtgatattggggagtttgaaagtctaattagaccacataaacgtattactctccctaactctcaaactgttgtttaaaagtgagtggttgatggtatggatgtagtaaagaaagagatgttatacaatattggaaaaagcaattaattgagagctagaggactttgattttgtaagatctttgtaaaatggttttacaaacttggagtttggttttatacagtcagtgcatagtaaaggaactatcattccaaatggaaatgaaatgttttaattcctttatatatggataaaatttgagaaacctcaaaacttttttttcccttcatttacaactattttctgccttctaaatagtcttgttttctctgcatttgaagtcctaggatctttaagtttcccattgaaaacctctctcagaaagaatcatggttttgtgccactgtttctttgtgcttagactggaataatatccacttcataggttacccagataattaaattagttcagacataaagagctttgagcagtgcctggcttgtaccaagtgttcaacaagcgttaagatgttattatcattatttatctggctttcagagggaaaaaaataaggttgtatgttaccttttatagcttgcttattttaaaaaatttatgattgacacataattgtacatatttatgtgataaaatgtgatgtttcaatacatgtatacattatgtaatgaacaaattgggataattagcatctccatcatcttaaaatttttcatttttttgtgatgagaccattcaaaaacctctcttctagctattttgatactttattgttaatgttagtcatcctactatgcaatagaacaccagaacttattcatcttatctaactataactttgtacccgttgaccaatctctccccattctttcctccccctacctcttcccattctctgctaatcactattctaccctctacttctatgaaaacaactttgtagattccacatatggctgagatcatatggtgttgatctttctcttcctaccttaatgtcctctaggttcatattgtcacaaatgacaacatttcattctttttatggctatatctagccataaaatttatttaattctgtgtgtacaccttttctttcttcattcattcattgatggacatttagattgattccacatcttgggtatcgtgaatagtgctgcagtaaacataggatggcagatatctcttagacatactgatttcattccctttaggcatatacccagtaatgggattgctggattatgtggtagctctatatttaattttttgaggaccgtccatattgtctttcataatggctataccaatttgtattctcatctgtagtgtgtaagactacacactctccaccttctctccatgtcctctccaacgtcctctccaacactttctctaggtactctccaacacttgttatcttttgattttgtttattaatttaatcatcagggttctaacaatcacaagattcttttccttgagattacttactttattttcctgaggaattagagatctgattccatgttttttctagttcctaaataaatatttttaaaattcactgacaggaatagtcaacaaaatgtgattcctagaattcaggatatgaatccacaaactaaaaatgttcttcctttttttttaaccaggattaaacaataacaaaacctaagtcaggatttatgggaataaagagcaaatgacatggaatcagaagaccttatttcaagtcgtaactctgctactttctaaatatgatcatttctcttaaaacaaataatgataatactgacatgattgtgaaaattaaatgaaataatatatgtaatgcactttgaaaactgaaaagtattttagagatatttgttacattgaaaaattgttcataaaaagccagtgaactcgtaggaacaaattaggaacttgatcaggaatagaaatgtcagtattcatttacctctacttgttctttgtgaacagtgtcaataccttagtcgaattcaactttaaagcacactttatcttccttcatagtgtagcaacattgttcttgctttattgaggaagatatttgggaggttaatgtagacaaagtccctacctttttatcctcatccataacacttgtttcaatggatatacaaactgaataatattacaagagcatcttacattaatatagaatttcatacttttcaaagcatttcacaacaatcatggcatctgagcttcacaatatatagtaaataatatataacccatatatgtgatatgtttgtttatatatacaccaatatgtagatttgtgaatgtgtatatgatgaatatatatgattatgtgtttacaccttttattgtggaaaaagtttagactttttaacattaacaaagctctagatttatccagctgtgtcggtgaaaaagcttacactatcaatatgagatttaaattgaacatatggccaaggaatttctatgtgtatagaaagagaaacaaataagatacatctaatcattttagttacaatgtccttcttaaagatagagaattaatttttataggacaccaatgccaaatttcagtccatttataatggaaaattttccattgcactaataatatgtaatatatggattcatgtcagtatctttttttgtcaaataatattttacagctggattttatacattctaagtgtacttcatcccaacacagttgctttttgatagtgtttttaaaaaattcttttatcttaaatttcagtttgtaaaatgtttaaaaaatttcagattcataaatccaacacctacaaatcacgtctgtgtgcctattgaaagcactcatgttccacatgcctaaagccaaacttttaactaccattcccacatgtcctcctgactatcagtaccaaaaagcagacagacaaaagtgatgcaaaccgggtcctctcctaagtatcccttttcccatgaacagcacctccattcaggcatcagcaagaagcctaggatttctttatactacctctcctttaccacccatgttcaacccatcactaggttctatcagtttaactcctaactctctttgaatctgtccacttctatctccaccttcactattaccaaattatccaaaattatagtcgtcattcatgagatctactgaaatgcattttaattggtcttcctacccgtgcttttgctactctctaatatagacatccagaatgatctttgtaaaatcaactctgatagggtcagcccttcaaatctcaccacacctcttatggcacagatcagaattattaatgtggctgagaactgcatgattcacttcagaagaatcagaagattttgaaaattaaataattatttttctgtttttttattagtgttcatcttcccattagtcttaccattgtatgctcaatgcccagtatataacactcataagtatttttaagtaatgaattaataagatgtacattatttcatcacatcattttatattataagcattttccaatatttcaatatcacttttatggtcatttaccttattaaattttttaattgtacgactgaagcacagtttcatcctcattgtgaaagtatcaaacattaaagagatgtatatcataaaatgaaaagataagttatattaatccccattttacttatttttcagtggaaaacactcatcagttaacagtatattctttcatatctttttgtgacagtagatattaatctatctattcattttaatggttctttatattctatagtatagatataattttattaaacattttcacatctgatagctattcaggttgtttccaacttttctgatattataaacaactcagtttgcaagctggtatttatacatttcagcataaatgtaagttttctgctaaaagagatacacatgtaaaattttgagatctaaggacatgcacatttaaatttttacatgtattacactatcacactttgcaaaaagatgtagtaatttggagtcctggttacaatatatgggagtacttggttttccacctacatacctttctggacacaagaaattatcagtctttcgtgttgtctcttttcttaatggacgcataaaatgatagaggtccataagtcgtaattatcacaaggtgaacacagccatgtgaccaccaccaacacctagagagaaaatattcttagccatccagaagctctagtgtctcctctcgttcactattccttgtctcctctgcagagatagactaacttcttacagcagagattagtttggcttgtttttaaattttataaaaatgcaatcatacagtatgtgttgttggtagtctggcttctttaactcaacctttatttgggtgatcagttaagctcttgtatgaacttttgttcattcattctttggcatagaaatttatttgtgtatgtgtcattattgttttaatttgcacttccctgatgtaaatgagattgatctccttgtatatgtttattggccatctagatacgcaattttgtgaagtacctgctaaagtctctggtctgttttcaattagatcttcccttttcttgtcaatttgcagtagttatttatatattcttgatctgagtcctttattcattatatattctactgatcttttgttattttgtgtttcccttttgaatgtttttagataacagatgtttttaatttgaatataccccactttctcaattttttatgttatgaataatgctcttaatattcaactcacaccaggataatgaaattaatttcatatattatcttttaaaagttgtattattttactttttacattgacaactactatctacctgtaattaatttttgtgccttgtacaaaatgtaagtcaatttttttctctcaagtgtatagtcagtcaggttgcaccaattattgaaaacattcaacttttcatactgttttaccatgccaccttttcttataacctaagtatctatatattcatagctctacttctgaattttattctgctgatttactccatctgtttttgtgtcagtacttagaatgttgaactttctctgagttctgtagtcccttaaaacagggacagttaaaggaatcatttcacattctagaaaactgtttattacacagaactactctttaccatatgacgtagataatactcatagataccccttcccgcaagtttgacttgacagtaccatttgccacacagttcatcctaaattcacctggtaattgaagtgttcatctgtgttacttacttgcttttattccaagaaaaaacaaaactcatatctctatgtcaagaagtagttacagcatggagccaggtgcttaggctaaactcccatggagactgggagatgagtatgctgccttttttgatacttacattcaaaagtgattactccgagaaaacataagaaaaaaatgcctgatttatgaaattggtaagacccttattagctttttaaaagacacacatctcaaagggacaaagaaagaatttataagttctctaaaagaaataggaggggacttcaaaattttctggaaaaacagaatttaaaaaatatatataaattttatttatcaccgtaagctttcccaggttccagacattttttgtaagtgatcatagcagccatttagtctttccctgaggaactgagggtcctgggaatctaaccatgtcaatgcagtcttacttgcattattaactgaagaaaaatggatgccccttccacacattttaagattaagaaacaaaaagaagtcagactgagccaaatcaggactgaaaggtggatgcctaatgatttctcattgaaactcttgcaaaaattgcccttgttttatgagaggaggagcaggaacattgtacctgtgaagaagggctctctgctgaagcattccaaggagtttttctgcaaaaactttggctaattttctcaaaacactgtcataataagcagaagttgttgttgttcagcccaccagaatgtcaacaagcgaaattccttgagcatcccccaaaaaactgttgccatggcctttgctcttgatttgtctgcttttgctttccctgaaccacttccaccgcttggtagccattgctttgattgtgctttatcttcaggataacactggcaaagccgtatttcatctcctgtcataattcttcaaagaaattcttaaggatcttgatcctacttatttaaaattttcattgaaaactgcttttgtctgcaggtgaactgagtacaacaattttcacacccattgattggaaaatttgctcaactataatttttcagtcagaatggggaaagctgaaccagttgagatatctgtggtgttggctattatttgtgctgttcatcattggtcctcttcaattaggacatgaacaaggtgaattttttccttgcaaattgatgtgcatggtctgctgctgtaggtttcatctttgacattatctcatcccttcttaaaatgagttattcatttataaactgttgatctctttagggggattgtcttcataagcttttggtaaagcatcagtgagttcaccattcttccccacaagcttcatcataaatttgatatttgttcttgcttcaattttagcagaattaatgttgctctgacagcggcgcttttcaaactgatgtgtccttcttagtctctcaaactaaatcctgttcggacatgttataacaagttagtatgagtttaattttgtgccaaaaatttgaaaaccacacatatccatttttcattagtgttttgaagacccctttgtactccaagaaaaaggaggtggggcaagtcactttgccttttggcaccagggaaaatctagttcttttacatctatccttacccttgcagtttcttccttttgttgttattaacagtttctggtaacaaaggccagacacacttcacttcctccaaattcttattcttcgttttatgagtggttagctgaactgtttatccccattgatccatcagaacaagcagttgacctgacttgaccaaactttaattaagcttctcttctccctataggaacctgaacactgacctaccctcaacttgagccagtattgtgatgtatagcagctcctccttaacacaaagaaagataatccctgacacttgcttacttctccctatgaatgaaatcacttttctgcctgacatttcagatgtttgcagatctcctgaaactttctttctattgcagtagtccctctccatcttttgcaataattttttcaaataatgtattttcaggcctaaattcaggtttttttttaaattttagaatactatgctttacttatcatagctttataatacatcttaatacctggtagtgtaaatatttccactttgttaacatcccaagagagagttcttattgtggtgaatctttcctaaggaaataatctaaaatatgtaaaacaggtcatatttatgacatcatttgtaaaaattaaaactacctagcataaattatgatctatttaccgagatggaatatggagctgctcttaacatgaatgatgagtttagatgatgatgattcaagaactacaaccattccaatcaaaaagtccttgaatggtgaaatgtaaaagaaaggaaaggtaggggactatgtataaaacagtgctgaaaaaaacaaatttagcaattagaaagaagaaattttgaaaagttgttggaagataaaaagcagatgagattgaattcacagaaatacaagagcagaggataccaaagcccaaatcatattcaggataaaactgatagaaatattcaagttgttgcaaagtggctgtagagataggatcactttggctaataaattcagatatcaggtaaaatcccttgtaaaaataattaattgaagaagtattcaagacagcttggataaatatcaattctactccatattcccccaactgaactgttagtagtgacattagtatcctacttgaagccctaattatagtagaaattctggcacaaagaactaaagaggaggtttggacaggagaagcaaaataaattatggtctgttcacccctgcaccccatcaaatgaatgctctcagactcagaagctaaaatatctgcaaactccatataatccctcactctacatcttcctgacaaccaagagaagcttctttctataattagagcctgtatctacattcaaagtagacattgttaaattgtgattgaaagaaatgtggaaagcataaagttctgagatgtgatagtgtctctttgcacttaccttgtaggtgtactatattctctcaagatgtccttttggcatagaagatgggaagaaaaggtttgggattgaaagactgctaaactctaacacttactcatctgcctatccactccatgatgtatgtataggtttgattgtgaaaatctgagcttattttcctcctgccatgttcattactgggagagagaatcttcctttacttcagttgcttagttttctctcatggtgggaaaatccccaaagacttcttggttctgagctgagagctttacgagctatgctgagatatatagtaaatgtatctttaaggtttcaaatggacatttattttaaaaacttttatatttgcacatgactttttattagaacccattttgaaaatagcagtcacattaaaagaacatttttgaacataatatttggaaatttctatctgagtcctttagttcttttctcatttataaagttttgaagctgtaaagaatttaaattacctgcattcacatattcattcatcaaatacatgattggcttcaattatatgtaaagcattctgttaggcattattggaacacaaccatgaatccaagctcatagactaggactctcctagaaataaagcatgtgtacaactgcaatataaactaaaggcttcagtgcataagaatgcttcaggtgttatgacaactgatattcagaagaacgttttttgggggctggcaaatcattgtacaaaaacattgagtttataagtttaatagagaagtgacattttacgtgattcacctgttgaaccaaacctgaaaacttggccttggaaccaatactcagcctaatttctgggtgtttttgatggaaaccttctcatttgaatagccagtgtttaaatttcaccacctattggcagtggaaatcctggggctgaatgtgtacatattctactttgagatcatcccttggaatgtctatttttgttgtttcttttgttacagttttactcttccatacttaaaaagactttttggtgatgtattctctttgtaagaaatatagttctcagtaatagaagaaacaaatatttcaattgaaacaagtggcagctaaataattccccatttttttgaaatacagtgttgctgtaatagttcccaaaagcccaaagccaagctcttcctttcataggacttagtctgttgtgctagttttcctctgttaatgtttaatttttgttttgtttacttttgttttttgagacggcgtcttgctgtgtcccccaggctggagtgcagtggtgcaatcttggctcactgcagcctccgtctcccgggttcaagcaattctcctgcctcagcctcctgagtagctgggattacaggcacacaccatcatgcctggctaatttttgtatttttagtagagacggggttttgctatgttggccaggctgtaattgaactcctggccaatgttcaatatttattcagtagtatgagaatttactccaggtcagttcaacactgattagtttttctgtaagagtagaggaaattttccaaaatgagtcgccattttcaacaggagtgtcaatttagtaacttaagtattagaaaaaccaaacagcctcttctttttttcaacagcccttgaacacatatatagtaaacatccactgagggttggttccagaaccaatccccggacccttggataccaaaatcccagcatgatcaagttcattatataaaatgtagtagtatttgcatatagcctacacacattcttcagcatactttaattcatctctagattatttataatacccaatacaatataaatgtaaatcgttgttacactgtattgtttttaaatttgtgtgtgtatgtgtttactgctgtttaaaaatatttacaatctgctgttggttagatttgtgggtgcagaacctgcagatacagagggcccactgtcacaatttttttttcctggggcaaagaaactcttaggagattatagattctaaatactaacatggacgtttggtaaagcagaaagatctaaagtaggttaataaacactttgcattgcattctgtccatctttcttcacaaaagacctcatagttttttttttttttttgaagattttgagttttttaaaattaatttttagggcattagttctattcttacaatgccatatcataaagccaaactaatgtcttcagtcatcagcaattttaaactatgcatgtagcctttcagtagagtcatataggctcattggaaattcgatgtcactgagctatcactggagatagctataacttactggtgattttactttttaatctttctttacttctgaatgcagtgttaggcactggattttcccttatgtgctttacagaatcatttttcaaaatacccacataggctgcttttttggttgtttaatttcttaagattcagttggattacctacagaagaagaaaaaagttggaatctgggtgatataaaatttaacaccttatcatataaagattttcacacgtgctaaattttattttatttatttttttaactttctttttcttttattatactttaagttttagggtacatgtgcacaatgtgcaggttagttacatatgtatacatgtgccatgttggtgtgctgcacctagtaactcatcatttaacgttaggtatatctccaacgtgctaaattttaaactggatatttattcagtgctgccttcagcagttcatttgtctgcagtaaaaacagaatgtcttaaacagccacagtgtacacaatactttgctaggccatgaaaagatattaataatattagtcagtatctaacaatgggaaaagaacttatgcatcaagcaataccaagccccttaaatgctaaagtttgttgtaatattttaagttctttgggaaatggctatcagtgaggacagaacaggagtctcttccagtaatagcagtatgactttggattagttgcttaatgttccttgaagtttaattttttcatctataaaaaaaagtgttagcccatttctaaagtcctatccagctgtatagtgatatggctctctgggccgtgaatattatattaggatttgagtagagaagaaagggcattccaggtgaaagaatagcttgagtaaagccaaagtcttatacttttacttgcattttgagatagctttgtgtgataatttaataaataaatattattagtttatgaaataatttcacatcaattgaatatgaaatctaaaagtaaaagaaaacatacccttgtttactaacattcttagaacagcagtgtttatttacttcgtctttgtcttttgcttcgtcttttatgtaccctcctcttgaatatctgcagggccaatattggaagccatcagaacctcccaatcctaccaatgaaagatacacacttcaccagaattgggctcgattttcctatttctacaaggagcagcctttagacttgattaagtaagtttcatacacaggatcagaccaattaaaacttgataatgtgatttttattcacaatggcataatattttttttactactattttctcccactacatttcacaacttcttgatttcatatctacactataaattagcaattcatttaggagaatgttgttgctaaactgatgaaagacaacagcgatagtatggtggttaggaggttagaccttagcatttagctaggctgaattccaatccaagttctgtctcttgaaagctatataaatttggtcaagttacttaaccattatgaaaatagatataacaatattactactttttagcacattagttataatatctatactatctgtaaaacgggaatagcaatattactactttttagcataggggctaacacttagtgtttaatacatattagtttttgtttctcttggagtccagaaatttggaacataagacaaaggttgtgtatggatgtttgtgtgtgtgtgctctcagtgagctgtgaagacatttgttctatgacctcaatcctttagatagtttcattagctaagcaagaagactatggttgcaggttatcactttaaagcatagcaatactacaagcatacaagatattaggagacatatgattttattcaatgaactattagattagagatctcttgctactataggcagtgttttttccttgatgatttatacttgcattgctatgcttacacagcatcacagtatctgtttcatgagactgatttgaatggatccatccaaatcaactgaaatgttatctcaacagtatgtttaagtcaaactagaggacacattttggaaaattaatgtcacttagtcagtttataaactggggcttttgataaatcatgcaaactctttcttgaatggctattttaactgttttgaataataatcatttaatactttaagttataaaaccagaatatttatcaaaaacatttcaaataattaagagatgaacaaagttttaagtgaaattctaccttcatcaaactccacaaaaataactag

SEQ ID NO: 558 - DNA, 45166 bp, Homo sapiens
tgccaaggcaaaaagataacttttaacagttagagaggatcagttgcttaaatgatttcatgtcagtgttgtatttatggttttacaataaaacaacctttaggaagatgcagcgtatggtgttttttttcttgggtttgaggatgggccatactgtccagttaggagcagagcacctgcagggcccaggtgagtggagatgggccagagacagggcacctggggtgacagcacacatccatcccagcgggacactgtgtgatgctggcatcgttgacttaactgtggtgatggtggtatcagtgacttacctgtgagctcgcagctcatctcttgcaccagacctggctcagccagtgtttgataaatgagggagggacatggtcgaggaagatgtgaccctcctgggcttgtggagcattgtcccatggaggaagggatggatttagtctccatcctccaggtctaatgcctcaggcgtatgtgcaggttggccctgccctgcggtcatcgcgaggctcctgtgcccctttacctagtggctttggccccctaaatggtgtgtgtgtgttataactgttgtatgtatcatccatgtgctggggaagagtgtccatggcttttgccaaattcctgatggcatgagggactctgaacaaattagaaatcagcgccctccaccatgagctgctagaggccagccctggtgggctcaccaagcctgatgccgttcagatgtgcagacaccaatgttcttctggaatagaagcaaaccaaaggccagtcaagggagaagagagaccagcaggcaagctggggcctgagcaggagggggtgaccactcctcctagtgggcccactgttagaacagccccttaagaggtgaagccgccatcctgccatcaaggtgagtgagtgacagacaccccaggccctggcttgacaccatctttaccaggtgtgggcaactctgcttcaaagtagaggatgtgttacttgatcacctggaaaaattccatcaaaccgcacgtgtaacagcacaaagagcccattggagcaccagccctgccctcaaaaccatcctgccttaggagtttcatgctaagagaactgtgtggatgttctgagccgatgattgaagtttaatagaggagtttctatgtagcctacaatgaagtcaggagtcctgctgtggccgaaggaatcctcctccacactcttgaacattgcagtcaaataaggccagggcatggcccgggagccctcacagctgaaggagcagcctctggattgaaaaaaaatgctttcaaaaggggggggggaaagatgtttctttattaagcagctgcagctacatttattttgtaatggaaataaatgagtgtgcccagcacctttgaaagagaaatttgaggtgagactatttaagaatggagtgaatcgtcaaggtaagtgtgtccactgtgcggagaaagattcctggcaccttctgaggtgagcattgtgaattcctcagactcggggtcacaaggtgccgctcccccatccgacccctggggtttaaaagctagggtgcattgatttttaaatttatttttagtgaaaagttatagcaagtgtcacagagtcaaatgcccctggaccaggcaggtcggtgagcagagctggttacacaaggtgaggcccttccggtgggggggagggggggggcatctctgctaagccccagctcatcgttggcatcaggatgccaattatttttaagagaactgagaaacccagatttttatgtggaaactcagttttcgagtgacgaattcagagctgtgaaaaaatacctcggccaggcgtggtggctcatgtctgtaatcccaagactttgtgaagccaagatgggaggatcgcttaagctcaggagttcaagaccagcccaggcaacatggtgaaaccccgtctcaacaacaaaaatacaaaaattagccaggcatggtggcacgcgcctgtagtcccagctactcaggaggccgaggtgggaggatcgcttgagcccaggaagtcaaggattcagggagccaagatcatggcactgcactgcagcctgggtgacagagcgagaccttgtctcaaaaaaataaaatttaaaaaaatacctcgtgagcaacgtttccttccaccagctgaagctggcctgtacacctgcagctcacaccctccaatttaaacattttatctttcagttcaagtcacttcaaaatatcactcttcaacatggccccttcaaactgccgtggctggctggccctggtatgggaggcacgtgtggaaggaacaggatgtggacacaggatgggaggacctttgttagtcccaggccggagggcctctcacttctcctggacaattgcctgtctccctgcacctgaccccacctgcttctgcccagaaagtccaggccgtgaccacagatgctgtccctcagggcagtcttctctgttggaacctgtaagccccacactttggatgttgggggagacaaagggagggtcttgatgtgtctgacccaggggactgcaaagctttcaatcctcaaatccttgtctccaggttcatcccctcaaccagaagtatggaatccctccttcctgcctgcctggtccctcaagccaatgagctaagggcacaaggggcgaacccaggactgaactagccaccggcccttaggacgctggtcacccacagagaagaggaggtagggccccgcctgggtttcttctgccagcgtcagctctccacttcagaacacacaaagctggggcctccaatccctccacagccacagcagccatcggggctgtgggtggatgcagttagcaagagatatttataaatcagacgtttgtaaagcctgtgtgtctacactggagtatcctggagttgtgttcttgggccaagtttgtcctgagctgctctagacagcccacctactccctttcccaagggtgaggagaagccagcccaaatcaagggcttctggccctgggccagggcccagcagttgcactggacacaatgtgaaggccagtgagcactctccttccaggacaaaggcccaggggaaggtcccaggggatgggctccccagggccatgcagagaaacagctgaggctttccagctccggtcagctggttctggggatatggctgcagctgaagtaaaaccctggggagatgttttgtacagcaaaggacaggggaattatttcaggcatttgtgggctgtctgccctgagctccttgggcacagcagggcacaatcaatcatttcttctgagcctgggtcactgatgacccaccaaacctctcccagagacaagtccccagagtgtcttcctttctttcctagccttattacaacaaaacaaaataatcccattttacactattgtaaatagaactttgatttgtttcaaaatttgcatagccaacgtcatgtactgaagatagttctattatgtttccaacgcagttttcacttctggggaaagctggggttgcatatggccccaccctggctttttctcccctccgccaccctgttagttacacttgtgatgacaatgaacaatgaggacacagaatttcaggagtttacaatttagtttttatttggacccaggttgcttggcgctgcctgccacaggaccccgggacagacactggccatcctctgacttgcagaccggccagttgtcagttggagaagcgcagcagctcctcatcacctgtggacacagagagactcagggaggggtccgtaggcagggacactcagggaagggaaagcagctgtcgcctggggccagaaacctctgcttgctgaatcatttatctccaaagggtattccatgaaatgatcagatttttttttcctcttctggtttaccgcaggtgccattttccagtgggaaaatcaaggcacagacatcttcaatggttgctcttccctggaatgctattactgttaccattgtatcgttgtcgttattattaggagcagttgctgttagctgagtactaactccgcgtcaggtactgggaaggctgggaggcaggtgctttgtcccattttacaagagaatactgacactcagattggcacttgctcaacgttgcaggtgcaaaattagaacccagctctgccccactcctcagtcagccctgcataccctctgccagtgcctggctaataactccccaaggcccaattccagctggggtaaggccccaggctcagccccatttcagagagtagatgggctgcttaccaggtacagagtccagaactcagctctccagacccctactcctcccagggctctcccacctcgactccaacagcccctcggcccagcctggcaccctgcagggctgcctaccatcaccagggacaccgcagtactctctgcactccttctctgagtagaacttgttcccgttgccctggcagcccccgtaggggaagaggacgcacttccccttgacagcatcaaatgcccagagctggatgaaggctcggcaggggccccggactatggggagattgcaggccgctgtggagtggagagaggcatggaacttgagaaacccttgtgactgctgatcagacatacatgagactgctgagccagagggccctgctcatctagaacacctcatccctcgttgacagatggggaaactggggcccacaggaagaaaatgatttgcccgaggtcctccacatccaaaggtggaattcctaagatttcaggaaaccgcctggagttctaccactggaatgccctctgttagctaccttttcaattcgcaggtggtttactggagggacagggtcttgagggtgcagagcgcacaggggtggggacccgcactcacccacagttcggcaggtctgcagacactccttttctgtgacgaagttgttaccgttgcccatgcagccgccgtactggaaagtctcacaggccatggatgtaccattatagaaatacctgctggtcattcccatgcagggaccggccgagtagcccagctggcaggaatctagggaggggcagaccagcagcactgaccaagtgttgactgtgtacccattatcaggctgggcacttgatatgcgccatctcatttaattttcactaaaaggattatcaattctttttagataagcaaactgactctcagagaggtgaagtaacttggccggggtcacatagagctaagattcaaaaccctgtctccaaaaccaatgcccattccactccatgtcatggggagttaccagtgaaccacaggcccactgtccccctgtattggtcttgcctgccccaaaactctgtaatagtagttgatgacatatgtaccagcacccacactggccagcctgaccttttcaccaagtcccacccaccctgcctttgctcccactgttccttgctccctggaatgccaccctccataaaactttacctggatgcctggacacagtgtgaattcccctttatccatgaagtcctcctgatcccctcacccctccaacgtctcagctccccctgccctttagctgacccttccttttgggcccatcacctactcccttggatgccttccccactagaccagaagttccaaaatgacacaagtggtctgtgtgaccctagtgcccagcacagggcctggggcggagcagggttcagtgtttgtttgctgatcgagttggagaggaagttgttatgtcatggacactgtcaactacacaaagcattcacatgtccctccccgacttcctcctacaagagccctgatgtttagccccacaggctattatcccataatatggatgaggaaaccaaggctaggaggccacacagtcatacagacagggcaagaaccagcttctcatcatggagttgacagttctcaagcccaggacgatgcctcatgctcttctctctgcccccacaacccctggcagagtgcagagtacttgatttgccttttctcagtccagcccttgagtctctaacagataaagagactgcactgataagagtagccagggtgagccaactgtgggcccttcctttctggagtatggcagagggggtgaaaaggcaggtgttcattaccttctttcttggtgacttcagttaccagttgcccaccccctgatccttcctcttcttggggtagcacagccctccggactctctgcgggggagagaaagagaagaagcagttgcagactccttgccgctattgctttcctgtacccctggaatatataaatgaacaacttgctttgggaatcagggtaggtaggaacacagctcttagactggttaaaggagactgttttcccaaaagtgtcaacctgaattcctgaacaggcatcagaggacagatttctggtctgaaatgaaatttaaaaccatgaggtatgacaatagccccatatccaactcccagttgaagtgcctaaaggaatatagtaatgaaaaggtacctcccagagttggaaaccaggggagagcagcaccctcacactaaagatgtgaaggcattgttgcacaacagagcacaggtgcaactggtttacaggaagggctgaccagatcatcattagctgcttgcagaaaaaaaaaaaaatccagagagaaagaagggaccctgaaactgatcctaactccttgctgtggtggtggggactgcagagcagggcaggctgccaaagctgccaagagggcctctgggtgtagagtccttgaggcaggatcccagggcaattatagaagagatgagcagccctgcccacaggtgagacctggaacttgagaaggtagctgtagtaatctcaaaatttcccatctccttttcaggggcaacaaaacactgtgaaaactgtcagggactttcactgtcttccagaccagtcttaagctggtggcatataggctttccttgatgaggatagagaaatggagaaaaatcgtgggacaagttaaatactgcagctgccagaattgggttgggatgaagaaatacccttactaaatgggagatattctggatcttctggaattcaggttgatggcagtaagaaacagaagaacacttaaaccttccctgaaattcaagatgacatgcatccaaaaaaacaacaaaaaaaagatgacatacatccatataacaggagccaacagtgatggaaatgaatatgtgaaagtagaaaattgttgaacattaaaatgatgttgaatttaaccacaccatagagatgataaagtgcagtttccatgctacaggaaataaatccacataataggatttccaggagagaaaatcaatacagaaataatagaagaaaactttttgagttaaagaaagatttgagttgcccaattatagggaaaaagggaatcaggcaaaattagggaagagctccttcttggacattcctagggacaaagaataaagagcctggtggccctcagagtaagtgacagcatttaacgacagaagtcccagagcaatatctgaaggttttaagagggaaaaggttgtaacccagggatccttcactcatccaagccactggccgtatgatataaccacagaaagacattctcagccttgcaaggattcagacatttgccacccatgtatctttcctgaaaaaattatttgtagaaatagtcccaccaattaagaagggaatctaaatgccagaaattaaagatgtaatgtcaaagaaataatgataaggtataaagccaataaaatatagagttttacaataaataattgctaacatggttatgtgatttactgggaatatttagaaacaattttttttaaaaaaaataaaggtagaaaatgtaaacaatttcagatcatatccacaaaaacaggtatggggaaaaatctgaaaggatgaacatggtgagaaacgggaaatagaagtgtgctgtatttcactcttttgcaaggggagtcattagctttggttttattcttgacattgataaagaaatacagatttagttgacatctggattaaaagagcagattgaaactctcctctagagttctccccccaatacctaacatttagcaaaaaaaaaaatgagtttaaaagcatagccccagcccccaaattgtcatcagtgtcactcaaggaaaggatcccaacttaaagccaaaaactttaaaactggcaaccaaggaaaaaaacacaagacattttggaaccgaatagaatggctcagctgtgccctgcaacctccaggcctggtatgtcatcagatttattattcttcctaatacttctaaatccagaaggagaaaactgaggggcaccccatccctttcctttcctgacagaggagtagtgaacatgccttttggagagaaaggagtaaaaagcaaaaatggagttcacagaatgggaggaatggtagtaaaagttccagggctatacaattgagtgctccaggacatgttgtcgtaggatggattatatcacaccagcccacctagggataatgagccccatccagaacattcagcagtccttccaaacagaagcagaggaaggatgttatggattgaactgtgacccccaaaattcatatactggggtcctaaccccccagaacctcagaatgtgaccttatttggaaatcagattgttcagatgcaattaattaagatgaggttattagggtggaccctaatccaatatgagtggtgtccttataaacgggtgattcgcacacatagagaactccctgtgaagataaaggtgggaattgggatgatgtttttaacaagccaaggaacaccagagactgccagcaaaccaccagaggccatgggagagacacggcacagattctttctcgaagcccacagaaggaaccaaccctaccaacaacttgatcttggacttctggcttccagaactgtgagacagcaaatctgtgttgtttaaatccccagcttgtggttctctgttacggcagcccccggaaacacacagacagtattcagacccgcatgtgcacctcggggcagttcattaccccacccccacccccaccctcaccattcccttggactttacaaaagttgatgaacataaaacacccagatcttacactaaagtaggatggggctagggggaggtgggattgggctcaaatttgatgggaagaggaccaaggagtaaatgacacctcccattgtaccagaacaaacagaaagtctggataaagctgacgaagaagaagcaagatgaagataaatggtacagaaactacccaaacccacctcagaagtgaataaaaaaataaataacctgaataagagaaagagcccagctgtggtggacaccttaataaactacctggatttccctcagcaatggatgtactttctcagtcgctggcagtgctactgtcagacagcccccaggggtcagccccttttggggactgtggcagctaaaggagccatcttacccaaggtcatgcgcacctcccagactgatcaacacaggggtattagggctcagcccctttgcagcatcttgggacgtctctgaaatgtcagaggtccctgtagtgttggctgaggcattgtaactgcatcacagctggactgcttcctctgccctatcctgccttcatgtcttctcccctacaggtgttggtcctggggaacccaacctgtgataccagaagaaaacagaactcaagaaacagaaggaaattcctcaatgccttcaagctatagaattacttaatcagaacatgcatttatgtgcacgtgtgtgtgtgtgtgtgtgtgtgtgtgtgtgtgtgtagagatggggtcttgctatgttgcccaggctggtcttgaactcctggcctcaagcagtcttactgcctcagccccgcagaatgctgggattatacgcatgagcaaaaacaacagaataagatgaaaagagaaaatccaagcctacagaaacaaattgagaaccaaaacaacataattcagaaccagcaaataaattagaaatagaaatagcaaggaacagaatgaaatgacggtctgcacaaaggaatgactgctaaaaatgcaatgaatgtcataggagagagactagtgataatcccagtgaatgcagatggaaacgacaaagagatgaaagcgactgggaagaaactaatagatgtggaaggcaaagatgctcctggatgagagaacaagtgttcccgaggtagcaaaacccaacaaaaggaaggaagataaactcaatgatatcaagagagatttccctcaaacacagaagaaatgtaatctgtatatgaaaagagaacattgaattccaggatgtgttgttattattattattattattttgagacagagtcttgccctgtcacccaggctggagtgcaatggcgcgatcacggctcactgcaacctctgcctcccgggttcaagtgattctactgcctcagccttccaagtagctgggactacaggcctcagccaccacacccagctaatttttgcatttttagtagagatggggtttcaccatgttggccaggatggtctcgatctcctgacctcttgatctgcccgcctcacctcccaaagtgctgggattacaggtgtgagccactatgcctggctcaggatgtatattttaaatagagacaaggtctcactgttgcccaggctagagtgcagtggcacaatcatagctcactgtaacctagaactcctgggctcaagcaatacttcctcctcagcctcccgatttgctgggactacaagtgccacccactgagctggctaatttaaaacaaacaaacaaacaaacacactttttgtagagatggaatctcactatgtggcccagactggtctcaaactcctggcctcacgtgatccttctgcctcaccttcccaaagtgctgagattacaggaatgagccactgcacccaacccccaataaatttttaaatagaattttcaacatcaagacaggttttgttaagatgttgattttaatgataaagttttcccaggcatctgaacagaagaaataaattgcctacaaagagaagaaatatcacacgggtctcgggctttttcatagcaataatcggcgcttgagaacaatggagtaacatatacaaagttctaagggaaggaacacgcgacccaagactgttgcacccaagcaaaatggcatcaaatatgaaggaaactgactgaccttctcaaacatgggagaattcatggactgaaacacccatgaaccctcctcaaaaacaccacctggcaaagaaatggcactaattaagagaataatagaaataaataactcgggaacggagaagctgtggttatattcactacaggtaagaacagaatccactaaagtatagaactacttctaaaagatgggattatggagacagagaagacgggaatggtatcgatctagacaatttaaaagacaaaagaaattttcgaagagttgccacagagtttcactctcaaagggagtgctcctgtctgtctttcaagtcacggagataataaatatactctttaaaaatatacagtgatggcagcctcttaaatgtcttttcacaaccttgactttagaagaatctttaggacataaatcctctcatgactaaatattcatttgaagatcaagaagtccacttcagtttctttaaacaaaaaaaaaatcaaaagtccaggcacagtgactcacgcctgtaatcccagcactttgggagaccaaagcgggtagatcttctgaggtcaggagttcaagaccagcctggccaacatggcaaaactctgtctctactgaaaaaaaaaatacaaaaattagccaagcgtggtagtgggcacctgtaatcccagctactcaggaggctgaggcaagagaatcacttgaacccgggaggcggaggttgaagtgagccaagatcatgcagctgcactccagcctgggtgacagagtgggactctgtctcaattaaaaaaaaaaaaattcaagtaaaaccacaattaatgcttttaaaaattagaaatagcacttgtaatataatcccatttaataacagtatatctaaatttgatcatccatttgtccttttttctataagtccttttatccatatgtgtggcaagattccagaaactgtgtgactgctgatagttttgaggtggtgagattaaaaaaaaaaaaaaaaaaaaaaaacctttacttacctttatacttttctgtgttcctctaattctttataatgaccatttattagttttgtaagatcaatggtcattttcttttaaaatataggagcaaatatctaatgtgttaactgttaattctacataggaacaaggacattttgtcttttgtggggggtttatagtttcgcaattttcaagaatatttttccaaataaatatcacatatatttatatatatacacatatatatatacacacacagatatatacccatgtacatacatacatacattagtagaataggatatataattttccaaataatcagagacaagagaatgaagaaagtgtaactgatgtggcaaaatgcaagaaaataaaagagaagcataggaaagccccaaaatcagaaggcaacataggaaaagagaaggcttgagaagctgcttgttctcaggtttgctgatttttagggaaatcaattgatttcttttcatgctgaatatcattatttcattattgaggattgttatttcattattgagtgttttacttcttttagatgcttttaggcactgtgctaagaacttttctatatgtcattaaattctgccacaagcccagaaggtaattgtgattatcctgttttgaagatgagacaagtgaggtccagatggattggcaactagtccaggtggcagaatcaagatggagccccagtgagtctgacttcaacactcatggccatcgctgccttctctcaccccctccccatgactctgcctccccccgcagcaggatcaagtgtgcagcgtgcctggggcagagtggggtgggatggggtgggatggggtcgggggatgaggcactcaccgggattaagatgggctctggttcctgctccccagggacacattcacctaggtcacagagcaggagagaggagtgaataacaggaccaggcccaggggccatcctagacccggatttgtatctttggtgagcatcgtgctgggaacttgtcgtgccttagtccacttcatgaatggtcctgcctgtgtggcttgctcaaggccattcactggaaaagcaagagactggtggctgcaccatcattaccatctatccactccaccccaccccactagcatcattttatcagcatcatggaaagaatagcaatagctaacactgactgagcatttatgagcacagtgctattgtacttaatggttttattgcattgccttttacagcaacttctaaggaaggtgttattatgcccaatttacagaggagggaaatgaggctctgagaagttgactagccagaggccacacagctcagttcgaacccaggtgctcttgatggcagcagtgggccatccggagtggccgcggccatcacactggctgcagtggggaggcacgagcactggtggtagcagtgactgcggaagtggcagtggtggagctgggacccctgtggctcccacccctgaggcaggcaactgtgccacccccatccttatgcagccaggtagaccccactcccaggcccagagcctctgttgctccacactctggctccaccttgccatcctcgcccaccatcactgcggagaggtcatggggaggaggctgacagcccccggagcccacctctgggagcccctggagcctgccaccctggcggccgtcacgatggggctgggctgagtcacctgccagcaggggagcaatacagttgggcagagagggcccctgaggcagagctgggcccagggcagtgctgcacttgcacacagagcatggggctgggcctggggcgtggagctggggcgtagccttgggaccctggggtgggaaatgggagtggcgtccgcttcagggacccagccagtggcatggccaccaggcccaccccactaagggcaccaggttcctgtgccttgggaggaggctgtgtgtgaagccaccaggggccatgtccccagggtccaccccacattggggtgactgtcaagcctgatactctggatggctgggcctggggcctgcaatccattcctggaagcaccccttgggcagggctgcgagccaggcaaggggagcctcaggccacccctgagtgctggggccatggagggagcttgccacgatgtcaccccagccccagacaccagcctgggcccagcaagggcccacagcccctgcctcaggctgcaaaggggtgtggctggggctgcacaccccattgagctggtgggagctgggcacaagtgggagccctgccccttctgaattggtgggataggagctccccaggtgcagcagcagccgccctgctgtggctgtggacccaggcatttctgcactctcagggcccaggaaggtcccctgcccaccacagactctaggatgcctgctcccactgcctggcttctctctgctgttggtgcctgctttattttggagcaagatcagggctgagccagggtgctgttgcagcctggacaggtatgcacatgctcagggcagtgctgacgtgccagctcccagctgcctcagccccctccagactttgggtgccaacaagcgtggaagggaggccgagtgggggctgatggcagcctgacactggcctgcaggcgccccttggcatgaacagcctgggtgccatgaatagcagcaggaggctgacaggctcctgagtggaaggaggctggtccccagtgaagccccactttcaagctggggagggcctgaagcctggggcctgggccaccagtcctgtgaaccagatggggaagttggggtgcttttccctgggcctacccatggccgcccatgggccagtcagtacaaacttgcgtacagagcacccataaaaaccccagactcagccagattcgaacagaggacagagagacaaggggagacaatgggatgacttgcctgcagagaggagacacacactctagggcctcctctctgctgagagctgcagcctcagcagatgacctgcctgcagaaaggagcttcccattccagggtctcctctctgctaggagctgaacactcatcagaacaccctggctgcagaaaggagctgcccactgcaggtcccctccaagctgttctattgctcagtaaagctccccttcatctcgctcaccctacatttgtctgtgtacctcattctttctggtcacaggacaagaacttgggacccacaaaatggcaaggctaactgtaacacaaacagggctgaaacatgccctttgctcaccacattgcaggtgaagagaaggagagaaaagctgcagccctttggggagcccagacctgggagctccaccagccaggactgtaactccctctttggggccctgcagttcttggcatctccgagcttccaagcaccactccattccctggcgccagctgggaaatctgcttgtggtgcacctggtccagccatacccttacagagtgctggcaccatgccagcacctggagctgcccaccccatggcagcagccagtatgtttgactgcagtggctggaccccaccctcactcacacatcccttgccgcttcatgcctgagttgcagtctcccttggaggtgtgggatccaggccagtagcatgagccaagcacggtctaccaggccaagtgggtggaacaagcccagcaggcccaagcaaaactcaggcaaaggcaccactggccacagaggtttccagccagaaaagcaatgccccaaagatcccgtaacactctgattcctgagcccactttcttaatcccaaaactcttttgcctcctaagaggtatctgtggattctggctacaacctccctgagacacatggcagtagaatgaacactgaatgggttctagtctaagctctgctaggaataagctgtgagacttggagcaaatccactggcttcctgattcactatggaggggaggctgtggcgcctttttatctcagagggttatagtaaggacccaggggctgggatggtctctggcgcccacaagggacgaagaggggacaggaatttgaggcggaggggtgctatgtacctcggtcagccatggtgaagatggagtcctcagggatgcccacaccctgggcaaccactctgaagtcctgcaggagagtttccctcagctgcggcgcccgccctgcaaggaggaagcagaggagacgcctagaaccaccaggtgcttggagtggaagggcctgaaatgattttgcccagtgattttcacttagggaaaatttgaaaactattgatgcagtttaatctatttgatacactgaaggaaagacaggctcccaagaggaagaggggtctctcccaggttcccacccaggtctcctgagtccccacaaaggactcttccccttttttttttttttgagacggagtctcactctgtcgcctaggctggagtgcagtggcgtgatctcagctcactgcaagctctgcctcccgggttcccgccattctcctgcctcagcctcctgagtagctgggacttcaggcacctgccaccacgcccagctaatgttttgtattttcagtagagacggggtttcaccatgttagccaggatggtctcaatagccaggatggtctcaatccctgttttttttttttttttttttttgagacagggtcttgctctgttgcccaggctgaaatgcagtggcacaatcatggctcattgtagcctcatactcctgggctcaagtgaccctcctgcctaagcttcctgagtagctgggactgcaagcacacatgcactatgcccagctaattctttaattttttgtagagatgctgtctcagtatattgcccaaggtggtctcaaactcctggcctcaagcaatcctcttgccttggcctctcaaagtgttgggattacaggtgtgagccacagcccccagtccccactggttcttttaagggcctggaggctctgtaattctctgggcctggaattttagagatcaaaaagagagaatttcacctcctccagggagactcagtgattgtacctttctccaaattggagttttgtcagaaggaaaaagcaaaactccctgtgcttacccactccactgtccataaatcaatgtcctcccacccttaactccaatgggcacatctagtaatgagcctttaccgtagagcttggcagtaatggtgggtccatgatggcggctgaatttcttggtcaggaaaatggcatactcatcatagttggtgtggaccacataggactccatggttatgttccattctgcatgggaggtgcaggcagaccaaagggatcagtggtcagtagactcttctagctggaggtccgtcacctgtttactcacacatcatctcctcatccatccatctatccacccatgccttccatatctccatttatcaattcatccatattcaatctctccctatccacccatctatctcctccatgtactcacattaattcatccaccatcactcaatccatctatcctctccatacatcaattctcccttccttccttctttcccctatcactccatcaatttacctattaggtaactgactctttgactcatttatccttacatatattcagtcaccaatcatttgttcattcatccatctatctagccaaacattcatatattcagccgtaacacaattgtttggcacatagagcatattcaataaacattttctgaactaacaaataaattaatgtccaaatccctctctcacttagcatcatgcacactgtacgtggtagatgcttagtaaatttttatcagctgatagcaggtgcctaagaagacatgaagactggcgaaatcagcaccatcaccctactctgggcatgggcactgggtgggggcagggaaggagagagggaaggggaggaggagaggaggagaaggaggaggaggaagaggaggagttgtttgggggaaggctagatgacatctcagctaaatgggaggaaaggttacagaggcagagggagctgaggacatcaaggtattttcaagcaaaggagagaatgcatgtgtctctttccactccacttactggatttgtgatagagaaacttcccatcagtatctgttttctcataagctccagacgtctcctcacagacacctttcctagaaatgaacaaatcaaaaggaaggtcactcctggtagagatcatggtcctgacactcaaccctcctgcagggctctttccaaatgccttggttttggggtttttttgtttgtgtgtttttgtttgctttttaattcggaaatgaacatttccaaatgtcttgtttaatcctcacactagccctgagagacccccattttccatatgatggagggacaaagaagaagagacaaatccatgccatcctcctggcaaagccagcactaatgccgccttccttaatcaaatctacacattatactgaggcaggaggagctggagtgatgaattcctacagtcatccatgtattgttctgtgtctctcttgccccagttttctcatttataaaatggggatcatgatagtttctacctcacatggttagtgtgagggtcaactgacacatatgtaaagaacttggaggaagcactatatacgaattagctattattgttacaatgagcactatttatccaatggatatttattgggcagcacctatgtggcaagccctgtgctacatggcagggatacatgagagagcaagacagaccccattccctggggttcctggagcttgcaattgcgtgggtcaggcaggcaggtgagaggcagatgcaatcagtgtgagaagtaccacatgggggtaagtgtgaggtcctcttcgggcacaaagaagggcatgtaacctgaacctgggtgtctgggagggcttcctggaggaggtgacatgaaacctgagttctgaagaatccacaggaactaattagcccagggaaatgaggagaggtgctcccagtaaaagggacatcaggtgcaaggacctggaggcgtgagagttccagaactgaaagcaggttcacgtgagtaggactcagagtacatagcagagtgtgtggcaggagttctgggtgctgggagggtcctggaaagccacatcaagagtttgaatcttactcccagggcattggggagtcatggaagggtctcgagcagatgtgagttttcaaaaggtctttctggttactgggtgaagaggggatggggtggaagggtggaggtcagaggtgaggaaagagtagagaggttgtggcagacaaccaggaaagaaagggaggtggcttggaccaggatggtggcagtggagaggggagaagtgaacaggttgggggggatttaggaggagaatgggcaggacttgatgatgggtgacaggggagagaggagcccagttcccaggttgggtccctggggggctgaagtacccacactgggctaaggaatgcccaagggggaggagcagtttgcagaacaggcacagtgctgggacactgccctcgaggaatagataggacacctgaaaagggccgtcctggtggaggagcgtagagggatctggggttcagcgggaaggtcctgactggaagcagagatctgcaacttcccaggatggacggggctgggaaggttgtgggtctctgggtctctctcagctttccagccccaccctagtgctcaccgccaacgagtgctggtcatgctgatctccgcctctgtagcgccctctcccagcaccagcgtgctcactgtcatcctgtccatgatcttcttcagccaggggcaggtggaaccgatggccaggttgtaccacttcccatagatctaggaggcaggtgagctctgggggtctgcatcagtctcagacctcaaagcagacctggctgacatctgctccccaccctccacctcctcctcttcctcctccttctcctcaaaatgacttatccttttaagggataatgtcttacaactaatcagaggccacacaccttcaagggaggccagatccctaagagtggcgtttcaggcatcacagcgaacccaggaagcaggtgtgcggctggggtcccaacctgccctgcagaagggctaactctctcaagatgtgggatctgtccatagctccatcaaccactgctccccaagagctggagtcctgtcttttactcctccaatgatggggtgctccccaccttgcaaggcagcccacagccccatgttaggaattatttcaaaagtataatgaacatgatggggtcattcaggataggcctgcttcctcttcctcctgaaagtgcacgggacagctgaaggagccctcaggctcctacggaacaggccaatgtgccccacaccctttgcgtcccagactgccacagggacctgctcctcattgcccctctgccacgacctttccttgtccctaaaagtaaacaaaacccacatgacaccacagctagaaggttctgagacccttcatacagacatggagacagccccaggtgggcaagggtattctcaaagccaccccgggatttagggcagagtgggggctggaaggcagctctggcactccacactcacaggagagtgtcctgccccagtccaggtctctccttgtgcccaagcctctgaatgtctcccaaccctaatctctgtcctgcttcacctcttcccataagccccacatgcccaacccaaaagctgctggccacatgcccacgctgtgccaccccaggtgtctgtccacagtcaggccaggatgtgggcaggggacacaggaagagctaagggaaagatgccacagagagaggggagtcattagagaaggaagggctgggaggtctgggcaaagctaggtgtctgcacgggggctgcagggcagtggcaggcaggacaaagccttctctggagcaggttcccattaacacaagggttccccttggagcccacgaggacagtgcagaaggtgaggatgtttgactcatagaatgtcagccaagagacccacggaatggcaggggatagagctgtaccttcaaaggatcccataatcccagatgatctgagtggaagcctgagaccccgagacaggccgcacttgcccagcagggcccatctgcctggactccccatcaccacatccaccctaccacagagagcggcagccttacccgagagatattgaagttttcctgcacttggatgttgtcgggcggcgttggcacagggccagcgctcaccgccaggcaggcgctcagcagcaagagcagggccccgaggctcctcatggctatgggctcctctgccttggtatatcccacaggctcggtctagcaacagaagggccaccgcctccctgcaacagggcagctgtgaactgaggctggggaaggggcctgtggcttgtagttgacctcagtgtttgccctgctcagctggggccaattacagccccaaggacagctccaatcgatccctgtagcctggctggggtcagcagtaccaagaggccgggatggctgcttcagaagaggcattggccaagcacaatagggccctggagcaccaggattgggctccgccccccaaaagtcccccacagagggcatgcgaggatggggagcgacctggcctttctgctgagtcatgccatctggacctcacagctctgtgagccagcaggtcaagcctgattgggcccatttctcacaggaaaaaactgaggcccaaggagaggaagtgacttgccagagacctcagggaagtctatgggcagagccaagaccagaacccaggtatcctgtctccagagttccttctccagcccccaggcttgccctagcctttgcaaataatagagacattaacaatgatgactgttacgagcttccgttcactgagcacctgctatgtgctggctgtgtaccaggcactttacacgtgccacaggtgtccagtaaatccccacaacaagcttacgaagtaggtgctatttgtcccctttacaggcagaggagttgagtctccaagaagtgaagtgacttgcccagaatccctcagccgggagtggagtagctgggaaaggcgtggtagagaccatggacgtgggagccaggcagcctacagtggcactcactgctgtgtgaccttgggcaagtcactttacctttcagtgccttggtttcctcatctgtaaatggggataataatagttcctagctcctagcattgttgagtgagcacctgcaatgcgctaggacagtacccagcatagagtaagagctgagtgtttgtggtgggttgaacagtgccccctccagaatccatgtgcaccccgaaccgcagaatgaacctgatttgcagatgtgattagttagatgaggttgaactggatgacaggggttttaaatccaatgaccggtatctttataagagaatggtgagggagactcagacacagggacacagagagaagcacggggaagatgtggcgtgacgccgaaggcagagatgggagggatgcagtgacacgtcaaaaatcaccaaggattgatggcagccaccaaaagctagcaaaaggcaaggaaggacttttccccagaatcttcaaagggaacatggctctgctgaaaatttggtctcaggtgtctgacctccagtgctgagagaagacacatttcctagcagccctaggaaactaatacagtagttattaaacttaaggttttatttatttatttattattttgagacggagtttcactcttgtcgcccaggctggagtgcagtggtgcgatctcggctcactgcaacctccacattctgggctgaagtgattcttgtgcctcagcctcccgagtagctgagattacaggtgcccaccaccatgcctggctaatttttgtatttttagtagagacagcgtttcaccatattggccagactggtctctaactcctgacctcaggtgatcctctcacctcagcctcccaaagtgctgggattacaggcgtaagccactgcgctcagcctaaatttaagattttaaatgagaattttttaaaacccaggtccgttgtctgtgagctcacactcttgccagcaataccaaaggcctctctatgaatttcccttctccagtggttaaatctactgtccttacttcctccctgctcttggcatggaacattccatactctcagccacctctctgttagagctgggaatgaccccttcgggcaggcagtcccaagattaagacccctgcttatgtgagaatcaaaggattcccccatgtagtcagtgcagaaacaaatggtgtatcatgtcccttctgtaagattcagtcagtacatccctctttcactggtatccagaacaagtgtgcttctattcataaatgtgtttcctttgctccgtcaccctaaccttggccagtgattatattcccttcttgctttggctgctaggaagctcaaagccatgatgtaagtttaagcacagttactgtcttggtttagctttctgggacagttatcttcgtgttccttgtgttcacaaagtttctcaatctttgatgttttagttaatgatggtaatgaggaggtggtagcccccaacttctccttgttctgcatgatattggaggtggctttccctcgctaaagaccactttccgtatctgtgaacggaagaaaacagttcttgttctgtctgtcaagaggccaagagagacaatgtgtgaggaagtgaactgtaaactgtccactgccttacctgtgtggtggctcaggggtgtctgccattggaggaggcaggcctggtataagaataaataaataacaatgaatcattaataggaataaaatcatcctactaagcccgcttacagtgcaccaagatggctcgctgaccttcatgttgggcctgcgtgactacagttatcaaccccatggtccagatgggaagcctgagacgcgcaggggtggagaagccccagtcctagcctctcttggacagggctgttcattcagttgcacagcctctcctgggggtggggagaggcccagaggataagtccaggatgttgatttcttctcctgcctccaggaatgtttgtgctcctgagattattaaccagagcaaacagagagagtaaatgctgccaagggccacttggacttttgactgctttttaaaaattaacctggggacacaagttgcaagaccaacagtggtcagacagctgctgccccctcctccccttctggctgctggggtgggaggatggaggctctggggtccctgccctcctagggggcccaggggtctaagagtccatgggaattgctaggttctgaaaccatttggttgtgggggagggtcttgcccctcacaggaggcctcagagcctcaggggtacccagtgcaatgtggaatagaggcctcgattttcagatgcacatactggggctcagggaggggatgggacttggtcaaggtcacccagtgtgtggccgagtcggggccagataggcctgactgtggcacccaggctctcccctcatcatttattcttgtgtctacttgttcttttgccaaatacacactccatgcttggtgctgaggacaggatgggcatatgacaggcctcccagagctcccttgaggcctggggttggggaacagacgaggtgagaaggtgataagacaggatggttgctgcagtgatcagggaagcagaggccgggacaggggagtcagactccaagagtaggagtgagctagacaacagtgcagtgggatgggtgcatgggggaggggagtgggttccatgcacagggaacagcaattgcaaaggcttagggaagaaaatagaaaattatttttatttttatccaaaaaatacaaataaatccacaggtctggagcttggggacagaagggagtggtgagagtgaggctggggaggtggctgaggtccagtaggtgggatcgtgttgccgtcccaaggggtgttgcttgggagtgcacaggggcactggtgggttttcagaagtcaaggtcaaccagattagtaatcgggagagatcaatcaggaggtaacgtaagctggagacccaggaaagcaactccttaggagattttccaggaagaaggaaggggccgggccagggcactaggacccagtgactggacccacagggacatcagggacattgactgggagtcagaccagagggtgtggtcaacctttgagtcctcctctgccaatggtggaatgataaggtgactttctccgtgacaggaggccttgcctccaatgtctgaccttgctcaatttccatggcctcgtgccacagcctgtccactcagggtcctcatggcatagctggaggtgcacagcacccataactccatgactggtgatgtggaggggtgttctcactgccctgtgatttctaggcattgttactcatccctacacctccaacccaaagagcaagtccacccagagacttgagtcctagtccttgtggcttgctgcgggacaatggggcagtcatttccctccatggcttcagagctgacataataactgaatgagggtcacttgtgaaaatgcaccccaagtgtgtagatacgtaggacccctgtcatcatgggcgcttggtaccgcatgtgctccagctaaggactccatacatagctgcaactgcactaaggtgtgaacttcccttgtccaccagggggcagcagagaacttcccgaaagaaccaccggagtttgctcacagattgttctgtacagatggagacagaggccaggagcaaaggctcaaagagctacaatgcgggctcgtgtccaggcttccttgccccaagcctacttaaaatcccctggtgagtgtaaaacatttagcgtctaccttgcccatccctaccctgctagagagcttgatgcttggttggggcccttaaaaaaaatagttttgctggggaaccagaattgggtgcagttgttgcagaccacgaaggctactataactgtactaagttcttactgtctgccaagtccacgcagagcactacaagagcatgtcgttctaaatcctctattaagaatctttttggagtggagtggctcaggcctgtaatcccagcactttgggaggctgaagggggcggatcacctgaggtcaggagttggagaccagcctggccaacatagtgaaactcccatctctactaaaaatacaaaattagctgggcgtggtcgcgcacgactgtaatcccagctactcgggagcctgaggcagaagaatcatttcaacccaggaggcggaggttgcagtgagccaagatcactccattgcactccagtctgggcaacaagagtgaaactccatctcaaaaaaaaaaaaaaaggatctttttgtggggtggtggggagggagaggatcaggaagaagagctaatggatgctgggcttaatacctaggtgatgggtatatctgtgcagcaaacaatcattgtgcctgtttacctatgtggcaaacctgcagatctgcacatgtacctcagaacttaaaaaaaaagttgaagaaaaaaataatcttattatgctggtagccctattttgcaggtagggaaactgaagctaagacatcaggtgatcatgcgttgaaggtcacccagacattaaattcaaaccaagatctgtctctgttaacacttaaggcactctgctgaccctatctcttgtctcttggctagatcttaggccacgttctttagacacttggagctgatgagtctcccttcattggactcttcacagccgaagtcaggcctatttctcccttccccagccaagggtcacctcagcgtctgctatatcaagtccagaccttctctccctccttggggcccagcactgtgctgggtgcataataggcgctcagccaacagtgctgactgacttactcagaaccatgggggagatttaggtcggatcccaagaaggaccacccacgcagaagacagctgagggagactgggaaattggactcaccacatccaaaaccccttaaccttatgtccaatgaatgagcaaaggaaggaatgactgggctctcaatggcaaaatttataaagcaaagaccccttgctctgtggtggcttgtcttcgagtcatcaaatttgagtttgtctgtgtattatggcctggagtacacccaaggcattgtccaacatgctgtgatgattaagctgctgaactttatatccagacagacctgggttctagtcatgactgcaaccctttcctgcctgtttgatcttagctaagtgacttcacctttctttctcttctgttaaatggggttaataagagctcatagcggtgtatgagaattaaatgatgagaagcatgtcatgtccttgctccttggagagagcttagtcaataataaacgttggccctgggtcggggtgcccttagatgttgtcaatccaggttcctgattgcaggagtgggtggcttagcctggagaagcactcctgcccttataatctttggagctcagagtgtctttgagatcagagcgccctggggacagagcttgtggcccaggatctagctccttttgcacccctgaggaaagggttaccaaagaataaacttccaaaggccttgtctgtgtccaggaaggggacgcaggcatattcctgcttgttgcaggccaatcttattgtccattgaagcaggacctccaggaacctgccccaactcctggctgaccgagttgatgcaacccagcatctctggaaggactaaaattgctctttcctgaaaccacgaggcaagctgagctctctggaaattcccaccggcctttcttcagtgaagacaaatggatttctctgaatcagttgccttggaagggcagtgggaactcttccctggctcttgcccttgggcgacagagtacttctttccactcctttccctggaagaatctgtgttaggagggtctccctggaggaaggagccagccgagctggatgtcaacaagttcatgagtctgtagtaatgagagtccagaagttgacacaattcctcccccgcaagtaatgatagaatgtttgtgctgaaagcatccgttagtaataataacagcaataacaactagcatttatttagcactaaccatgtgccaggctctgttctgaacagtttatacgaattcacttctagttctcacatcatcccctgtgagcatgtattaactcctcatagggtaaaccaattttatccccactttacagaggaggaaactggggttcaaagagattcactcttttgcccagcctcccacagctggtatgttgggcagacagagggtgagaaagggagagggtttgcccaaagttctgtagcctggagaccacagagatgtcctgcctccacccagggccctgccccatggagaaagactgggctgcagggctgcacttctaattgtctagattccagctcaggcaccgggtagtttttagagaatccctttggtattggggtggtgaaggatccaccaccggcggggaggttgagaaagtcccttcctctgcctcgtcaaagtgcctctgcgtggtctggccttgctggatcgtgccgggctttggtggagaacaatgtctctaggaaggcaccccaactatcctcaggggttcctaagttggacagaagctgatcctctacctgtccttcctctgtggtcccactgggtggcacctggcatggtggttgaggccagccaggttcaaatcccgcttctgccacccactggctgcgtgaccttgggcaagttctgaggcccttcctgccttggtttcctcactgcaacatgacaatactgacagtacctacttctcagagttgtgagaaatgagcgagctaacacatggcaagcgctgggagcagtgcctggcaccagagaaacttgctaattgctattatttgttcccttgcctcctgattgtcactttgcttgtcctttcccccacttggttggaagcttcttgagaagagggcagtggcccagggtcaggctgctgtcacttgtatccagcagaggcggcctggcctccaagtaggggcttggtgaacatgtgataatcaggagagccacacactggatgagggttcttgagaaagacacgtctgcccaactttcaaaaaagtcctctcaaaggtcttctttgccggcccgtgtagatgccagtgacagccagggacttgtctgacatacacaagaggtctgtgtcaaggcaggctttgaacccaggtctccagattccagtcatggtctccaaccccagcactaacccatctacaagttccagtagcttccagtctgtggttcataacaagaccacgcctacttgcccgacctgccctgccatgcttgtttgcctaaaataaaggaagatgagtcgctggatgctaaacaagaagatagaaatggaaaaaggacattgaagaggacacagaatatgccatgaaggggctgaatcctatcagaaacgggctggaaatgaatatgaatttggagcaaatgtgtcattaggcaaagagaagaaagaccttgtgggagggaaagcaggcccatttgggatgctgagagaaggctggtatggctgaagcaacaggatgttcttggcaagagggtcttcacaaactctcataacgactccaagttttggggtccatctgggagttggccccccagacaaggcctcacagccttttatgtacaagtgtccacaggagtgctcttctagaagcttgtgccatccaactgcaacgctttctgccatgctcctcatcgtgcaatgagagggggctgagagttgggatccccaaggatctggaaaactcaaccaaggatctgggcagccagcactctagaaacccatgggtggccttcagaactctggtgaatgtcccttacccactacatccctgcccagccaaagattccagagaatccctcccgacttgtctacagtgttttaaaatttcagaaagatcttctaggggtttggaatcctggaaaattcctgtagtgtctcaggatttccaagagcttcccccaattctaatgttccgaagtagcagagactttcttttgacagttcttgagaactactaccatgtttcggggtctagagaactgcccccaggttccagcaatctgcagaaggcctgtagattgcagggctccagaagtgtccttctgagtccacaagttctcggtaagtaccaaatgaatttgaagggtcttgatacattactgggatcctttggaattccctcagggtttagggatcctagaattatggcagttctagagggaggatgctgactgtattagtctgttctcatgctgctaataaagacatacccaggactgagtgatttataaagaaaaagaggtttaatggactcacagttccacatggctggggaggtctcacaatcatggcaaaaggtgaataagaagcaaaggcccgtcttacgtggtgacaggcaagagagcatgtgcagggaaactgccctttataaaaccatcagatcttgtgagacttattcactatcacgagaacaacacgggaaaaaccccagccccatgattcaattacctcccaccaggtccctcccacaatacaaaggaattataggagctacaattcaagatgagatttgggtggggacacagccaaactatgtcactgactgagagatggatgcatgacttatgagacaagggtagtgaaggccagtctcctcgagtcctacgactctctctggaaaaggatgtggggttttgccgagctggagtgtgaactggaaccaggaaactggaaaatcgtggctggctccagcgggaatcatccaaacatgaatgaaccagtgaggccagggtccccctgggtggtccccctccatcctcccaaggcgattaaggaaagctctcacactctcatgcttggtgccagggcctcccctgcctggggctgaggacctcccagcaagcaagcccacaatgcagtgaaataagggttctggggagtggggaggagcccaggcaggaacctgcagagccacccaagctaacgtggcattgaaattaccaatattagaaaataaaggctttagggcactcatcaggctcaacctccctgttcaggtctctgtacaaacatcacctccgacggaactccctgcttaggactgcacccctgccctgacagagctctactctcctgctctattttactccatagcattatcaccatctgacatgccacgtattttgccctctttctcgtttattgtctgtgttccatgagggtaaaagtcctatgctttattcagtgctagcccatagaaagcaggttctcatagaatgtttgcactgaaagcatccatgaataataataacagcaacgacaactagcatgtatttagcactaaccacgtgccaggctctgttctaaataattctgatcaatatatattgaatgaattttttttaacctgattgtcaattccatcaaatcgtcatgttgactaaaggttgcttttggcgaaactgtctgcaactggcaaagctacatgctccactctttccacgtgtcagggaatttcattcgcaagacagttttgtaagggggtactcttattgcgttcattctgggtataagtgacttgggctcagagcagttgagtcactagcccaggatcactcatgggtttgagcttgggtggctccgtctgtggcttaaccacagcctgctctgcctggtccagttgcctgtggtatctggctgtcaccttctgtccctgggctctgcctccacagattctggccttccaggaagccaccactgttgaaaacctctaatgtccagtcacaagtgtggtctaacaattcctgcccacgggggctccaaccgcaatggaccccaccagtcccagcttcaggaaccagccctgcatagactcaggagccaaggacctgcagtgggggagacccagagaggcccagcagcctgccccaagtcacacagcacactcaagcatccttgagacaccttgctcttatctttgggtcctcatgccactgggaaaaagggggcacattcccaaagctagtttccagaatgatgggaaggagagcactgagtctttccttgcttggtcctgcgccggggagtgtggtggggtaaagggatcctgatttcctcaggccaggtctgaggagcacagtggccagtctgagttctgttccagatgatggctgtgacctccctccagcaaccccagctgctccctgactggtcctctggcctcagtctgctgcctcccaagggctccccaagcctgtggctaaggctggcctgcccggaccttgcctaagtccagggcatgggtctgaggggatgcccagcccaaggcccagctcaggtactactggctgaggtgtctcatctcctctgtgctggtctctttatagtcccccaactccagctcatccttgccagtcaggccacctcccacaggtggccagcgtgacctaaatacgaatctaggctggtgatgccttaagacccttccatggctcccctctgcccttggcacaagcccaaactctggctgtgacctggaaggccctgcacttcctggccccgacaagctctggaacctcaggggtctgtagcctttgtgtccacagcccctccaccttcccttgaacccaatgctgtctaccttcctacaagccttagtcatggcctccttgggaaaccttctctgaccccctcaatgatcactgatcaagtgaccttcctttgtgcctccacagtcccttgggcttcccccagcccctgtgaggttgtaaatgcctgtctgtcccccaccagactctgagctccctggaaaagccaccttggcccttgtctccattgtcaccttttagcttgatttgcagttgatgccagtgtttttgctttgttgtttttcaaggctggagtgcagtggtgtgatcatggctcactgcagcctcagccacttgttttcaagtgatctgcctcagccccctgagtagctgggactataggtgtgtgccgccatgcccagctaattttttattttttgtagagacaggatcttactgtttcccagcctggtcctgaactcctgggctcaagcaatcctcctaccttggcctcccaaagtgttgggattacaggcacccagccatcagtgttgtttgttgaatgaatgaatgaacaaatgaataaatgatgtgggtctgtttccctaactataagtgaagagttaggttagcctcatagctctttctataatgggtcctctctctgcttcccgtaattcctcatgtcatactggacttctccataaccacagacccactgtatctgatatggtttggctctgtgtccccacccaaatctcatgttgaattataatctctaatattgggggagggacctggtgggaggtgattggatcatgggggaagatttcccccttactgttcttatggtagtgagttttcacgagatctggttgtttgaaagtgtgtagcacttcccccttcattctctctctctcctgctccgccatggtaagatgtgcttgcttccccttcgcccttctgccatgattgtaagtttcctgaggcctcccagtcatgcttcctatacagactgcagggctgtgagtcaaaccacttttcttcataaatgccccagtctcaggtagttctttacagcagtgctgagaacagactaatacagcattttactgggcacttatgccatgaatcagatattgctcacagccttgaccctcactagaactcagtgggaaggaaactgtgtcccccacttaattgactgaaaaccagagtggtccagagagggaacaggacttgcccagagtcctagcgtagatctgtggcacaagaagccaggcctcctgatccccaccagcgccaggacccatagtgacacagagtgagccccttgaccacccatctccctgtgctccaggccaaatcagtttccctcatgcctccttcatggagatgcttgccattcaactcccccaccgcctacccaatggcatatagcagttgcttaatcaaaacttgtataatatgtgaaaggaggctggctcacgcctagaatcccagcactttgggaggccgaggcaggtggatcacaaggtcaggagatcgagaccatcctgggtaacatagtgaaaccccatctctactaaaaaaaaaaaaaaaaatacaaaaattagctgggcgtggtggcgtgtgcctgtaatcccagctacttgggcggctgaggcaggagaatcgcttgaacccaggaggcggaggttgcagtgagctgagattgcatcactgcactccagcctggtgacaaagctagactccgtctcaaaaaaacaaaacaaaacaaaacaaaaaaccatgaaaggagatgggagatggaagcttgggatattccagactggaaggggacacacatctgtgccaagagtcctagcccttcctccctctaatttcccacggggaaataactgataaccccagaggatagaaccaaccagacttggagctgatgcctctctttattcatgtatttcatcccctgctgcctggtttctcctgaatccccttgttcccctaaatagcacccccagtccccgcccctagcccagctgcaggtggagtagcagctgctgtctccattcagcagatgggcagactgaagcccaagagtgtggagcccagtctgaggtcacacagcagtctcctgggttcccacttggccttcaatggggagggaggacttggcctgggctccgtgcgccctcactgcagggtggctggctgcggccacgtcgcagggagctgccaatctggtctctgagggcctccagtctctgggccaggtttggaaccccggccccacctaaggagcagtgagactcgaggcctgccctctccagggcccttcctcacccaggtccatctgggtcccaacaccctctggagaagcctcagggggtaggtaccctccacccttccccccaccccacccccatacaccatgggctccaacatacatctgggcacgcagatgctcctaaaaagagaattccaagtttgggaagtagaaagatcttagaagccacctctcaacacccaccccatttcagagataagactgaggcctggagagggtgggttctaccccaagatcacagagaacattaggggcccctccctctctcccttcttcacctctgagccctggtgatgtcttcgggggcctcacaggcaggggaggtgcagaaggtaccacctcctcctccgtcaacatctctgccaggactcgggtctgagtccagtcactgtgactcctgggccagggtgagttgggagatgggaggtgagcctttgagttccccagaccacccctctctgacctcagtgccccaggagagacccacctctctcttgggcacttggcagagccagggctgcatgggggtgcccagggtgggggccgggcagatgggggcctgccacctgaggcctcagggtccaacacctgtaggaaagaccagagtccactctgggtgacctcagtcctgcctctctgtgtcccacctacctggtgctagccatgacaccccaccatgcctaccccacaaggtaccaagaatgtcaggatggcataaaggggtggggtcttggtcgccttctgtgtgcagcagatggttcttctaccgtcctctcctgagactagaagcctcctgagagcaggaaccacgtctggtctatttctgactcctcagagcccagaagagaggctggtataaagcaaggagcttggggagttactgaaggagtaagtgaatgtatgattcagtaaatccataagtgagtagatatgtgagtgaatgaataagtgaatgacagaatgaattcctggccctgacagggcagggtgaggaggggggagggtgaggcaaacagctatttcaaaccagggcagagggagccctaggccagccattcactccccatgatctagcctgcagccctggaatccctggggctctggattgatgactcctggatcaaggtctccagttctcccagccttccctcactcccaccatggcctttcctacctggggcaggtggtgctcccctggcaggcaggcccagtgggccaggggcactcgacacagtgggcagatgtggcagcaggggcaggagtagaggggtggcagtgcctgcaaaaaggtgcgtcagaggctccatgacatccctacttgtcacccctccaggctgggccgtgagactcacatggcaagggggagctggggccatcaagcagggacacggtggggtcaggccaggaccctgctggtgatggtagcaggcagagaggagacgcctagaaagaacagcagggtctatgcctgcagcctccaaccctaccaccaagctggctttcaaatccccttcccagctaatactcctggatcccgtaccaggtaccgggccccattctcaaagttttacatgttaacttattctctctgatttttaaaacaagcctataagtaggcacgacgatgaaccccatcttacagaagaggaaacccaggcagtgagaagttaaatgacttgccccaggtgacacagctagtaggtggcagagctggaaactgaacctagttggtctgaatccagaggccagcctcaagcagttcattaagccatcccttttcccagctgccctctgtccagaggcctggctccaagctggtggctctgcttacctctctagtgcatggacctgctgggccaggatgcgctgctcattctgggccaggtctcggctattctgcagctggctcttttctttcctaggggagatcacaagccaggaaggggtaggaaatggggctggggtggggcatcagtcagctcctcctcattgcagcatagcaccagttcaggaagcaggtggggacataagggagccaggggcagggagaggaggcagtttgccagaagcagcctagcagtgatgggtggggagcagcatccctctggctgtgggctgtgccctacctgagcctctcattctctagcatgaactcctgtagcatcccgtacaggttccgctgggcccaggccacccgggctccactgagccctgaggctgcagggaagcaggaggtggtggatccacaggagccccagaccctatccccatcctactctgcctccaggaagcccatacccttgcagtccatttggtccagctggaactgcaggcgacggttctcctcctggagctgcagcatctctgtctccaaacgctggggctgctttgccacaggagactgtagggaaagaggcccagagccacctttatggttgtataagtcgtgcactgcacaagaacttccgggtgtgggaagtaactggggcctaaaatccagcccatgcttcattcgtcagccttgcatcttggcacaaggctgtatctgcctggaaggggcaccttgtcctaagtgcactgtcctggagggccccactctgagctggactcagctgtgagtccaatcccaaactcagttctgtccaaaccttgggccagataatggttccaaacgagaccccacattaggccccacatcaactcccacttaaccatgatactaactgagctagaccctgaatcatatcccaactcaaactccaaccctagacctgccctaaacctggcatgaccctggctgggaccctgaccccatcctatacaaccatgataccgattccaggattccaaccctaatcccaactttgacccagtccaagacttcaatcaagggactcaggctccaactcctgcctgatcccccagcatctccacgcctgtccctcagcttgtgcctgcctatactcaccttgggggcctgtggtcgggtggtgacccgctgagctcggcttgcatatcgcagggtgctgagagtctcaggaaggcactgggctgagggggacacgcaggccacctggggagtgcactccccctgagcgctcctctctgagggccccttcctcaagacccaaccttccctgccaggccccgcttaagtaccatgagggtgaccccgcgccctcccagtgagtctgccagcaacttggtgagcttgctgtcccggaaagggatgtggctctgcttccgctgtgggtccagcagcagggagatgcagtgacctggggagggagagcaagagttaggaaggttacatcacttgcctagggccatcaggctgggatgctgcagagttgggctctccacccaggcctgtgttgccctaaaaacccatctttccacatgatctcatgactcagtcagattggtctccaccaccagactgggactctttgagggcagagaaggccctgtataccctgaccctcaatgcccagcaaagtgcctggtactcaggcactcagaaggaaacttctaacaaatggattgtacacaaaggagtttcgcgggcatctcacatgcatgccacagaggaatactgagggcacagcccctgaggatctccaggtccaataccctggggtggggttggggagaaagctcaagtcccttccccttactaggcctcagtcttcccaactgcacaagggacatgccaaatgtctctgagggttcatcttctgcagttgagtggttctatttcccaaattagcatggaactttatacacccttagagtttatacattcataagcagtgttttacgaagggagaagtcaacagcagagctggggccagaatggggcctttggttcctggatcgcagctctttaaccctcttctatttactacaactcctctggtatcccccactgtggagagctgtgagccaggcacagaggagagacaggaaatcacaccggtggcccccaggtctcacccagggccagcaggcttcggttgatgctgttagcctcaagcatcagctccccacgggatcccgtggctgctaccttctcactgcctgccaggtccacaaagcacagcttcccaccaacagggggctccccagggtccacagaaggcatctgctgggcctgagggatcagagcttcatggggacttgggagggaccgtccccatcaaagccacaaggttatgggaccaagagtttccattattaacccccatgcacacccaagttggtttatatgtccagatacagacccttgcttggtggccccgggtaagcaccttcccaggctggagcactcacagtttgacggctgatgtaaagggtgagcagggcatggcttcggctggaggcctggttcagggtgtgggctgagttccttcgacggctgagacctggaagggaaaaacatcaggagctggacctggtaggaagaacaggtcatcatcaatgaagaaaaaggagcaaaggaatcctggcggaagggtcagcctcatgcaaaggcagggaggcaacagagtgggtgttgttcagggaacgatgggatgttgggccctgctctagcagagatgggtggatggaggatagagaaaactgagcagaagaatgacagtcagatttgcattttataaacatctctcccactgcttcgtgaaaggaaggggagaaactgaggcaggagatcagctgagaggtgtggcacagtgctggggccagaatccacagtcagcatctccagtgcctgccaaaggaggggtgcccaataaatacttgatttaaaaaaaagaatgaggctgaaagggcctttaggctaggctaagaggtatgaccttgatcctcagggccctggaagggtggagggtctggaggcaaagagagatggggtttgcagcatagaggagaatggatgggcaggggagagccttgaggtgcagagaccaccagggagcaagaatgagtcctggcggaggccgaggccctgggctagagaggagagggtgtgaaaggagtttggaaggcagaattagcaggccttgttggcagtgcggggaggcccttgggccatgcctttgaattgtggtttactggtccttccccacctcccccaggaatcatttctgaagctgcagctgcagtctgggccccaagtccacactcagtgaacaactgaggaatgggcacccctacccgcaaaactccccgctgtcagcacacacccgtttgcaaaagttccatcagggcctccagactcccaaattccaccacccgcagctgctccacatagaagccccgagtcttgttccagcgaacagggaggggccggggagaccccaggctcagcaagtcccgaacctgggaggggagggaggagggtgagggaaggggatctttctgagtccacccatccccagatcttactgacaacagtccccaccgcctcttctgtcctttgatccaggctccctggaaagaagcgctccgtttcctcatgggctgtctttctattcctctcattcccttacctgctcattgtagatctccagataagaggcgcgaagggtgacaggggcacccaggtgctgcacgcggtccaacagccaggcgaaggtcctctgcatgatgccagccaggctggggggtacaggcaccccctccccctaggggcaaaaccagctgagccatcgtcatctccacagtaataactaccctctgtagcgcatgtatgataccgtgcgccgggaaacgtgccaagttcccaaacaatggctcatttaattcatagtcggtactgtcacttccattttacagatgagaaaactgagagctaggaaggggccaaagttgaagcccaaatgctccaaattgggcaagtcccttctctttggtcctcagcgtcctcgtctgcaaacaagcgggtcaggcggcgtcgtcccagccccttccctctgggagtctgcgccgcctgcggctccccagggcttccagcccacccagccccgccccgcgggggcgccgccggcgctcgctcacctggggagggggtccagtcagggtgtaggtcttcccagagcccgtctggccaaaggtgaaaacagtgcaggagaaactgcgggcggcaagggcgtggctggactccggcggctacccggggtgggggctgggggtgcttcggggccccgccaggcccggcgcggagcggaggcgaagcttcactcacccgcgcagcgccagctcccccaggcgccgcacgccgcacgcccggaacacgtcctcctgcgtgcgcgccgcgtctagcaccgcaccgaagcggaacgccacttctggacccccgcctggaggactcacctggcgcgggtggggcggaggagcggggcactctggaggagggcggggcaccctggaggggcggggcaccgtggaggagggcggggcacgcgggaggagggcggggcactctggaggagggcggggcaccctggagaagggtagggcgctcggtgaggcactcggtgggcgagcaccctgggttgggggtggggtgggggacactcactagggccggggcattctggggagggtaggacaccctggaggggcggggcattctggggggggcgggcaccttgggtgggcgggcactcagaaggggcggggcactcgcaggggttggcgcggcgcaccctggcggagggctgggcatcctggaagggaggggcactctggggagggcggggcacctgggagaggaccactccgggggagcgcggggcctagggcaaagttgcctgggggaagggatctggcgtccccgggattttttattggggagatagagagaggggttcctcacctgcagagtccgggtccctgagcagtgcagcacgctctgctgccctcgacgcagctcggccgcgctcatgggacgtaccctggggtccgacagaagggcagatggtacatcctgatgtcttcctcgatccttgtctcgcccaggtgcctcctagccaatttatacccacctgagcaccacctggatgggcgtttccggcccctctggcccttgctccaggctccgcgcgagatccctgtgggcagcaatgcgacttatcatacctgcacctagcggctgttcaggactcctcgaacctgtctgaagatctgcttacccgtcgggtgacccgcgttcttccatgtcctgctctgcacacggagttagctccgcccgcgtctcctttatttaccccccaccaataccctcccttctccacaacactgggactgtctacacacatcttgcattcccaccccatcccccatcccaggcagccatccatccggaaagactccagctgcccagggctagctcgttaaagatttacccttcctcacccctgcggtggagaaagtctctcccaagctaggggacccctagctagggggttctggagtctgaggatcccttgctcttggccagtcctcacaagaggaacccgtgggaccacccagaccggcctcctttgtgcccagttggggatacctaagcagataggaaggactcaaccaaggccacagagctagcctgcacaggaccaagcttttcccaccctctccacataccccccactcccacccccagcagctcagctcagggcccaaggagtggcacaggtctcagtcagctctagggacgacctggctggattgaatctctgagctgacctgagaacaggtttccaagcatctggtaaaacactggggcacctgcctctctaatgccaaagttaatcctaggccagcatgattgtttaaccctctcctggtctggcttatgagaacagcagagatgtctgtgaatgtgcagggatggggcaatcacttattctgtaccagtctccatgctgggcaccagggcagaggaaccccatgcagcccctgacccttcccagctcacagtgtgtctggggagatggataagtacaacccagcagcgtgtagggcctttagggggagtacagaggcctgtaggagccagtgggggtggggaggaggtgagggtattccaggcaaagcaaacaggagtcaggatggccagggtggggtggggagatgagtgtggcatggagaggtagtttgaggctggatctagcttatggtgggcacatcaaggagtctggactcactcttcagggaaccaggaagccattgaagggttataaacagggatgtgacaccatcaggttggcattgttattattattgtcattctggctgtctttgtatgttctctgaatatttctgcaaactctccggcccccaaacacacattagggtgaaagccctaaaaatcactttttctcaatgtgacacattctataccaccacaaattacagccaactatcaaagccaccctgctggagaatgggctgtcttggatggcagtgagctccccaggcaatggagatgtataagaaagagccatttgaccttttggttataggaccctctagcaggggccacagggaaagttctgtagaactaataaccactgcccccagctctgccactaacttgccacagtcttggcttctcttgtttccttcctgtaaaaagagattaatgacttctctcctatttgacatagttgttctgagatttcaatgagatgtgtcattgaaagtgaaagttgtaaataattacctaaaaacaaaaataaaaattcctagatgatctctaagttccctttcaactctgaagttccttaatctattttttgagtccttgaggtggataagacaaaaattactatccctgtttttcagaggaaaaaaaactgaactaaacagcgaaaggcagggaaagttatctaaggagaaaacaacaaatggcagaactgagagtttaaacccagaactatgagctgtacatcctgatgctgcttgctatggcaagttgcttttgtcaggagtaaacccagtaaatgaacaaggtgctcctttaaaagctgttgaaagtgttaaagactatcaatcactagcatcttagtgtgcattggtttagtcagattgctggccctcctcaggctggactgagatgagccacgctgaagggatttttgttttttttgttttgttttgttttgttttggagatgcagtttctctcttatcacccaggctggaatgcaatgttgcgatcctggctcactgcaacctccaccttctggatccaagtgattctcctgcctcagcctcccaagtagctgggattataggtactcaccactacgcccagctaactttagtatttttagtaaagacagggagggtttcaccatgttggccaggctggtctcaaactcttgacctcaggtgatccacccacctcaacctcccaaagtgctgggattacaggcatgagccaccatgcccaaccttgaaaggattttgataaaagtgcagaaacaggggatatgttgcatgctggtcagtgggggcttgtgcaccaggcttcccaacctgggtcagaatgtgtacatgatttgatgtcctttgaatcacaaatgcaggagc

SEQ ID NO: 559 - DNA, 45323 bp, Homo sapiens
gtagggatactgtgaaaaattgagtaaatgacaaagtgggacaatgacatcaaaggagagggcaacagacaggacagcaacatgaggaagggcaaaaggcaggaagattcagccagaaaagcaggacgatcttagaaaattctgctacttgtacttccaaaaaagttaagaaaaagaacaaccagaatttgctaaaaatgggaatgaaatagatactaaaacaccaaataaagggctctagagagggaacaggaactctagtgcccaggctgttcccctgtcactgctgtatgcatattcagtatctccctggcctgcactggcctctctgttcaagtgggccctgtccttctctgtgagcaaactgtagccaaaagaatttaagtgctcatttagtcagttatatatgtattatcagagcttagtcttcagcagactgcctccagacactcaggaacttcccactggcaaccagtgttacccgggtctcaccgatcccgggtgaacagtggtaatagggaggaagatgaaggatagaaccattgcacagcagccttttgcaatcatctagtcctttaggaacagttctgctgtgctgtttagtcctcaggccacactgtgagaacaagttacagagcactgtggtgagtgctgaatgagtcagggagtagagataggaagagagagagagaaagggagagggagagagagacctgtaggtacatagaaaaggcaggaagcaacatatgtccttgactcatttgatactgcactttgttccacttcccaaggattcagtcactgcaatttacctttagcattccaggcagatagaatcctgctctacatatgaatctgggcacaaagccatgcaggtgtgagtaagcccatgaaggaagtggcactcaaagactctaggagttcaggccaggtgcagtggctcatgcctataagcccagcactttgggaggccgaggtgagtgtatcacctgagggtgaaaccctgtctctataaaaacacaaaaattagcagagcatgatgacgggtgcctgtaataccagctacttgggaggctgaggcagaagaatcacttgaaccctgggaggtggaggttgcagtgatctcaggtcatgccattacactccagactgagtgacagagcgagactgtctcaaaaaaaaaaaaaaaaaaagactccaggagttctaatatgccccattaggtgggcaccagaatggccccttgtaactttttcctaccttctcctctcctaattctttttctgtggaggaaacaataattgtctctgaatcatccctattcggagcattgaggatatattagaaggtctgggtaaacaagcagaaatattgcaaaagtgctaaaacatcaaacttcagggtcgaatttgtggtttgcttctgctttttctatccactctaaaggtgttcctgatagagaagcttcctcagtgttccctgtgttggtgtgtaagacagaaagaagatggggtaaaagagtgcacgcatcctccactacaaaccagaggctgatagcattagggagaagctagggtttggcctcacacaagcagtttgcactgttgtccaatcccaggtggggtggttgcctcttcatttcctttgatagcaaccgcctgttgcgtgatgtagtgtgggtgtcctcagaggtagctacctaagtttgcatacttcctgactgacagaacactcctgccagtgcctccaggccagggtggtggtgttggtgggaggagtaagtaaccaagtttcacttccttgccttggagactcagagccatagcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtaaggcagcagatctcctttcaaagtacctagtgggtggacattgactccgcactcccacctgcatgctttgattaatgactatcttcagtgccttgttgccctctgccacctcaaccatttatttttttccactttattcatttgtatctgttaagtatcttcttgtctggggctaattccattggaaaagcaggcattatttttctagatgtgaaaacaagttggttgagaaaatagggaaaaaaatcaaatgttggacattctttgagaagagggacagaattgggatatagaggtgatgttgcctggcttccttgatgttgctctggtttatgaataaatgcgctgttcaagagtttctagcactgacccagggacagtaaaaggactgtgtttctggtaagataaacagaaagcttaccctactgtaagggagagggactttttcaaaagacagagaatgaggaagttcctgcaacagtctcgcttgtatatttctttctcctgatactgcatttgtgagatttgatatcgtatgtatgtccagagagccaactttgagcctttcagtaccaacaatccaggaagaggataaaatttctgcttcaaacaggtaagcataggtaggtggagtcattggagctctgtctttaagaagggacccagatgacaactcatccgggtatttaataagaaacaagtattacacaagagaggaattggggatttcccagagaaactgcctaatgcactgggaatatcccaatgaaggtggctttgacacctgtgcatgaggagaggcaaaacctttaccttctgcctggacaaatagctctaactcttcatagcaatccaatgacataggagctgttgtcatcttcatcttacaaaggatgaaaacaagtaccaaacaggtttgaataacttgcttgctagtcacacatcaattacatagcaaagctgggcatccaacctaccacaggctatgtccgaaaccaaagaaaaaccaaaatagagttgaaatctctctgtgttaaggctgcagagattgtatctttttatgttgtattactgtaaaagtttattaataattcctgtctttagattataaaactgaggtctcggaattgaactctactttcatttggcaaatcagataaaacacctggaattttcattaaagaaaactccccttattaggaagccagagctctagaatctctctatccctctagattgaatccccaaacagaagaggtaaaaggcccttctgtgagcatccagcacaggtgtcaccaagtccaaaagctaaagctgaactgtggccctcagtgtcttattgaactattaagttacaatgctttacatgttctgttaactgtattcccagcccactgtaatagaaaaccccaaaggaggagatagaggaatatattcaattctggtcctttagttaaacaaacaatcctagaacccagagtctatggttgagtactgtgggaacacacttagatgacaaagatgaattagatgctgtctctgtgccccaccatgatgtcaacagcaagaagcaactacaggtgaaacccacgggtggaataggactgtgtctttcctccatgtgcaaagaatagacattgaatacaaaactgagtcacaccacttccctgcaaaaaaaaaagggtacattcatggccagatttccctatttcagaaggcgtgaacaattaataaacatgaggatgatttctatagcaatgggcaacctgcagttatctgggaaaactgctctacagtcctggttcttgaccttggctgtgctctggaacatcttgacacccaaaccacagacttgacaaatgatttcagtatctctggggatgggtgttttcttgtcaaactctccaagtaattccaaagtgagaccctaggttgatgatcactgcatagaatatgtatctaccaaatgcattaggtaaatgtggtcttgtttttcattttaagtctgttgggtgtgtacttgaatcttaaaattactaataaatgttgatattttgtttgttggtttaggggcatttcgattagcaactttattgaggttattttacatatcataaaatatacccgtttcaagtgtacaattcaatacttttgactaactttacagagtgatacaaccatcaccataaatcagttttaggacatttctgttctcccaaaaagaaccctcagatgtatggcttatttaagcatactcaacagtgtgctggaaaaacagctgggaagagttggggtgtggagaaagccctgatttcaagaatttgcctaattccctggtataaatactcccactatagacaatttcaagctgccaacaatttaacatcatcgaattgaatatttaataatcaacttgtgccagtacttgctcctgcagcacctcactgatacattttttatagataacaatttgagaactcttgacaatgacttgttgcctctgccagaatactgaacataactcgaacattataatgactttttctttgaacctttaaccactggcgagatagaatctctaccaaaccttctgattaatttagtttccaaagacctccttaaaaacaaaatgatttaatgtaatggatagataaaaggtagctggttttaatgacttaatttttcaattatttttaagaggttatttgagtagttagataaatccttacgtttatgtttttgatagacataaacagataagttagtggttaaattacagaaatagcagaagtctttgttcttgggcctctgtttttttcaggctctggaatatgtaaatcctgtaaattgagccctgaactgcagcaaatccatcacttgcctttccaggacatatacaacttgctcagagtacaggtttattattttctaaaatacctaaatcaagcaacacagtgcttttccatgtctcatttatagagtgtcagcctaaaatcattaattttctttcatctaaaatacattaatgtgtccagaagcaaaggagaaataaaaccatcttaaattgttgctcagcttcgcttacacttctcaggggagggtatgggcttagggggaagagaggtgtggggagggcaagaagtgagggtgtggagaatcaggggagaggaaggaggtggaccatgaacgaggagatgggtcaggctgtttgctgcttgcaaaatgaaaatatggcaaaataaaacaagtaacaaatactggagatatcacctaagtaacaaactggtaaagaatagctagttaaattactgaaaattccagcaattctttggctttaacaaaggttactatactatttctacatatagctatatatatgtataaacacaaaagaaataacaaaatgaaagtgttttagcatactttaaaattaaatattcaaatgatctagtcagttgtaactccaagtgagaaacataataaacgttctcttttttaaatactttctcaaatcgaaagttgtataagaaagtgccagtgtttggctggattggccagtgccaaagaactagattccaagctctgaatatttaaataaattgataactaattagtcacatataagagaagtttagagtagaccatggagcagcaaaccttttttttataaagggccgggtaacgaatgttttaggctttgcaggccttacagtctctacctcaactactcacatctgctgttgtgcaaaaactaccagagaacacagaaacaaatgaccgtgatggtgttcaaacaaaacgttatttatacactgaaatgtgaatttcatataatttttatgaatatttttctatttccctcaagcatttcaaaatgtacagccattcttggctcccagtccatactaaaacaggtgtctgacaggaattaaccctcagctggtggtttgctgacccacggaataaatgataataaacaaaatgagtccgtattataaggcaggcattttgtagacaccagctctggtctttgaaaggcactggtattccagctttacacaggaagagactcaagagcagaaaaatcaggttgcctacagtctctgagtgtctgtgttcaaaacccatgctgacttcacaaaccaggttgtttccctgctgtgatagtcctaatttactgaccacctactatgcatcagcaccataccattcacacgcataatgccatttaggcttcacaataacactttcaatacgatatcaccatactcatttcatagacgcaaaaggtgacttcaataagctaagtatacgatccaggtcacagactttgtaagtagtggagctgagagacacacctaggaacttaccccagagctttccactgcatggtgctgctttgtagagcccactggtcaaaggtatgtattctagtaatggcaattagtaattattggatgcttatcatgtgctaagcactagtttaagccctttgcccatgtgaacttgtttaatttacacattgctgtgaggtgggtattattactaatgttgtccccatttatagatgagaaaagtaaagaacagagttttaatcacatgcttaagtttccattctaacataccttcaaatccaagagttttgctccagagccttcatgcttgactgctgatgtaacctcctggttttcatcaaatttctctcatcttactatactagtacatgttcatagttcttaatatgaactgagagaagcaaagaaagttctgtgattataacaaagtttactataaaagacattattctttctattcctcacataatatacatgcacatgtacacaaagccaggccagcattctagttaatcagaacattattgaattttgtgtagaattcattttcaggactagaaaaatttattcagctaagaaacgtaaagtcaaaatttcagtggaacctgtttacagcggtgtgacactaactacagcaatacagcttgttcctcttctgtgcacagctctgtaatcttggattctaaaaacggaaggtggttcttctgtggttgtataattagtatgtaactagtgtacagttccatctcttcataactcaagtgaatttcctcttcagttgtggtgtttttctgttcctccaaagggtgacttccttctacttacaagtggaaatctgtcccacagactgtccatgttgtggggagtcactttgtttcattcattcactcttctactgggtcatagatctatctgttgtatgatgacgccaggcaaggcagcatagaggagactacaataaagaaggcatggctgtgcagagatggaggattcatatgcatgtagagttagaatgcagtgttgtgtgggctgagggctgtgacagtgtctagataaaacaatctcctatggaaggctatcttctccacagtagaagtggagaagatggccttggagctgatatgatttttgtcagttgaagttagaaaaggtgaaattttctacagagaaaatggcctgaataaaggagtgatggtagcaaaatatgcaaggattcagaattgaaaaagctcacatgaactcagacccacccagtccccaagacccatctggtttgtcagcattctggtggtctggttctggtctctacctctatccatctcatcctatgagaagcttcaacttggcttttctcttgtacttctgttttcatgaccatactcttagatattttgttaaaacctgcattaatttctggctcctaccaactcccgtagaggataaattcctattctgagcccatcgacctctgtgtcctactgcctgatagaggcctgcctctaccaagagcacagtgaacactgctgggccttatcagtgttcgctgctcaccacttgcttctttatggtcatgcttcccctgaccctgcccactagcacctgcccccattatctgttgttagaccttctttgtttaaaaatgtttataactttaaaaagtgtaagagtaatcacttgttttaataacagtatgatgattatgtaaaagaatgtcacttttgagagatgcatgttgaattatttagggttaaagtgtcaggatatctgtaatttactttaaaactgttcatcgaaagagtcaaaattaaacgttgtattaaaaatgtggcaaaaggttaaaaattattctacctgaaatatgggtattatttcaatgcagtaacattgatgctatttttctactttccagtatatctgaatttatttataataaatagttgaaaataatagtaatatatattaattatcaaaaattagagagatgaagagaagcatcaaaatataaagaaaagcactaaaatgtcagccatgtactactacctaaaataacattgttcatcttgattctagtttttaagaaatgtttttctgtacacacacacaaacatatatagagattgaattgtaatcatattatatgtataattttgcttttgctttttggtaggatatttttccatcatctccttcttgatctgtctcaaagtaggctcttgcttccctctgaaagcatggatatttaggttgatctagattctggagggcctaaaatagatttggtcaatgaacaatgtggactcactgaaggttcataggaatgtggaattacatagtcatcatgttttgtttttaggtagattaatctgatagttcagcatgatgggtggcaatggggctagagccaagatagtgggttagtgagggagttttcagattggtgagtaggaaactagagtgctaacccgggaatagtcaggaaggaacaagggtagaatccagcaattccattgagctaagcaaaataagcgactcatgtccaaacaaaactagttctgcttttgtgtatgttttcaaaatggtatcaaagaaattttgaaaaccttaatgtctcacaaatatattataactcattgtttgctttatcagtataaatttctaaattttcctgggtttcatgttactgctcctagagttctgacttatacaagttgattgcatgtttgggttgattcaccagatactcttgaaaccattttgcagatgtcagtcctgaggtactaagaggtttagccacttgctttaggctagagcacagtaaactccttttaatggtgaactccttaggagcaggacagtggtttattcatctttgccttctccatctgagcataccacttgataaagagcagatgtttaaatgttgaattgccccaagttgagtcaaggccaagaccagaactcaagcctcctgacttaagccagtgagctttccactgaaccaacgctgatgatgtacttgcattcatcactttcagactcactcagtccccttatgcccagtggtttttactggtggaataaattgacgttggttagaggtatcgcctaaaccatggaatagagaagagataactaatgaaacaagaatctgcctgtattttttttacagaccccaatgtacttatagctctttcctatagctgaagcttcctgaaagtgaccctctctgtctcctacactagcccacaatggtaggttgtcaatggcaaccacagtttgaagacaattaccctgaaccagcactttgtgagggataagttacaagagtaaccatagtaagcccagagtcaagcttgattttacttgaagatgagccctcttaagagaacctctgattttcattccctgcctagtcattctaggccttttcaaggttttttccaatccaaataaaatgttccctgagcctcagttactggagagcagtggtgcttttttggtcttgcagccattcctgtactgtgaaggcttccctggggaccgaacagaaggatctcagtacagtgagatgcagttttcacccctcccgcaagtagtggctctgtccctcaggtctgtccaaatctgacttccctgggtatgttggtccatctctgagtcaggctctgtggatttttctttatctttaaagacatctttatctttcattgttttctctgcccctgtctcctggatcactctttgggtctgcatgtgcattccctaagtctctgtccccatgtgcttctggctatctgtgtgagctggcgagtctatcttggtctcttgagttttgtgtctctatctttctatccgtctgtctgcagctctttgacttttgtgtctctgagactttgtgccactctgtctctgaatctctgagtctccatgtctgtctgtctctgtgttttcgtcttccagagcttcttgcatcatttctcagacttcttcaagaacaggttcatcctgatctcaaactcctacagaattctctcctccctttcagttttgatttccattagctgagccttgactcccaccaaaaaacttgggacctgcctttaactcacagatcaatgagatatttgcatgctccgcctctgtcatcactcaggtctgttttctaaagcctggggcagctggtctcaccatttagctctgctcttagctcatgtaaacatgggcatttagaaaagcaattttgaaagatacagccctgctggttccatcacagaaacgtctctattggagagactctagagaatctttctttggcctcccctgtatatcacactacacctgtctgagaccatgtaagaacttccaaaatcctttataaggcttcggcttgattccctctatttgaacagggtccattgctattatcaatggaaaaataagcccacacttgtgaacatgtgacttaatgggcttgtgtgggcaacaccatctttcttagatatgtcacaacctgattctaatataaattacagcactggtagctcttgagttacataagacaccctaaacccatgatttctaatggcatagagggccaaacactttacctttcacaaaatcaaagtatctagcaccgaccctatgaacaaatgagcatgaatgaaatcagcagccaaggaatcccatggaatagttcaagtggtaagaacagattaaaccttagagtgtgaacgcctaatagattcatctttgttctatcactgttgtgttcagaaagattgtgaggctaagtataggctcagcaagaaagacacatcaattagctgtgccatgtatgaacttagagaaggggtgtggcacatatgttatgcatttgtcatctttggtctagatagttcagaggggtgtcagtgtcatataaaagtgagaacaactttgaaaatgaaataagagaaaattttctaaagaagaatgcttttgttggctgttcaactccagggcattttggctgttttaacacaatcaggagtttttttcccactttgcgttgaaatatatgtcctctttataactctgatgaaacagaattgaggttctatttcatgtatcttttccaggcagggaaaaatatatcattaaatatgtgaataatctgtagacatgagttactaagacattttgtcatcaagaaatatactatctaaatggatgtgtggcatgtgttttaaagtgcaagattgctttctgtgtccaccagttcttccagaattattttgcaccacttcccaacagggaccctgtgctccagctaggcatttggttgcccatgcacaccaagcccatgtccactccagtgcctttgcttatgtcatttctcctctcagaatgcctctcactgcctaatgaatcctatattcattcttcatactgcagtttatcattctcccgctccatgaagttttccctgatcattccagcccactgtgagctccccttcctatgctataatatttactgtccatatcactaagatagcagctatttggtgattcttctatgttaacctgcagatccttctcttttccattctgttggtactgaaaagtcacttagtactttgctttgcccttctcttcaaatgccaaattctgtgaactcaaactgttcacattattgaagtgaattaaagttttcaggcccaagagtccttcccatacatgctcctcaaactctaaagtgcataacaatcacgtgggacttagcaggttgagggaggggcctgaggttgtgtgtggtccatgttggctgctcattagcaactcttttcacttgacacttcccagtagtaaaaagtttcttattgcacctgattttaaaaccatcactcttggctgggcgcggtctgtaatctcagcactttgggaggctgaggcgggcggatcacgaggtcaggagatcgagaccatcctggctaacaaggtgaaaccccgtctctactaaaaatacaaaaattagccaggtgtggtggtgggcacttgtagtcccagctactcgggaggctgaggcaggagaatggcgtgaacccgggaggcagagcttgcagtgagccgagatcgagccactgcactccagcctgggcaacagagtcagactacgtctcaaaaaaaaaacaacaaaaaaacaaaacaaaaaacaccatcacacttataagtgcagatgaaggaaatgacctaattggaagttttaatcaacagtaagtccagtgtgaatcagctatgtgatgcaattgtgaagaaactaatgcattctcgggctgccttatgtgtgcccagcagccagaataagggagctcctgtgctgctttgttttgcaggtcagagtttaacgttaagacagattttttaagtttgaaaggttttcagatgagatgagttctttgggtgataaggtccctggatgataaaggaactgaaagcctgtcataaaaggaaaagctgaagatgatggaaagagaagaaggtgcattctaaatgctttcaactctttctataagtatcatctatgtaactccaagaagtagctctgaaaccatctgctgaaagccatctacacagcaaaaaatggcaattcattgtagcccaagagttttctaaccatgaatcatgaacatatggattaagcttgcctatacaagtactgagttccccatcattagcaatatgtaggcaaagattggataagagtactatagagtttagaaattattcaaacactgttgttgtgcatttctgacaagatcccaggtgatgctgatgctgttggtccatactttaagtagcaaagctttgcactgtggtttaaacatcaggtacaacccgttagtaggcttaaagtgaatttaatgggtcacatcaatattcattcaaaataaagagaaaacaatatattcaagttaatagcctatagaaagataggtgttacgtcctgtaactttttgttttttgtgcgtctttgtgacatatgtatgtttatatatatacagagtgatataaaatgtattttgtactgtgagtcaattcaaaaaatttaaaagcctctcctttaaagaacagaacaaatgaggtataaagttagattagtaaattaaaacagtaaaacccagtgggataagaaactatgaaggttccactattctggagcaattttccagaagattctagctcaaagaggccccagaatgaaaggaaaggaagctgaaccgaggaccagctttctggatccagcctgtccacattctctgtggctgagtttattttctgtatcttactaagaggcagctatgaaaattctttagtgggtggtgtttcctagttttttactgtatcatggaaaggataatatcactgtttccttcaagttgaattgctggttttcataatcttataaacccagtacaaatattcttttggagcttgattagtcttttctctgttgactttatcagacttgagacataattatggcaatgtgtgggccttggggaaaatggagactattaacattctttctaataggagtttcttgctcttttttgcttcttcagggaaaatgagactagaagaattttttttttaagtttcaaaaaatgaacctattcccaactgcataacagtgtgttcctaccactttgcaaatgtctagcatatccataatacattgtttaatttagcaaatctagttttttttctgtaaaagttaaagaattgcataaaaaatttataaaagaagaaaatttttccaatacatgaaaataagaaggttctctggccaggcgcagtgactcatgcctgcaatcccaacactttgggaggctgaggttggcagatcacctgaggtcaggagtttgagaccagcctggccaatatggtgaaaccctgtctctattaaaaatacaaaaatttgccaggtgtggtggtgcacacctgtagtcccacctactcagaaggctgaggcaggagaattgcttgaacccgggaggtggaggttgcagtgagccgagatcacaccattgcactccagcctgggtgacaagagtgaaactccgtctcaaaaaaaaaaagaaagtttttttcctaggcattcttactagtcaccttgatggatgagaaaactgaggttgctacttgccagggggtcacatagtgaataaggtaaaaattgttggagcagatagactacctgagggaacgaccagagacaaatgcatgacctctcctcaccaacaattataaaaacttcattactaatcacattgagaagctgaaaatagcttttctatactatcaagaagtttttaaagtgttctagatgaaagactgaattatcattccattcccccatagaaaattatattattaaattattacatgaagagacaatcaaataccagacagcaaaaatatagagaaaaaaattataaggtttgattcaacagttaattaatacaaatacgttattttctctgtgttgtgatgtttgtgatatttttgtttttaaaatttgtaatttgcgatttctcattttaaataaatattcctttcttttttgtaattttgcataatttgtcttaaagagacctccagattttataagcttcaagaccattgaaatctgcctcttatccctaataactggaatattcaaatttttaaaaattgaatatagttctggcccggcacagtggctcacgcctgtaatcctagcactttgggaggccaaggccgggagatgacctgaggtcaggagctcaagaccagtctggtcaacatggtgaaacctcatctctactaaaaatacaaaaattatgcaggcatggtggcacatgcctgtagtctcagctactaggaaggctgaggcacgagaattgcgtgaacccaggaggcagaggttgcagtgagccaagatcataccactgtactccagcctgggtgacagagcaagactctatctaggaaaaaaaaaaattgaatatagagcaaattatagaaactgtaaggtccatgcaattagattttatgtaatgagctattggacatgcatattaagccacaggcagctctataaacatcagacaaggaactgtcagtattcagtgccacatatagagcctcaatatcctccaccttcatctctcaccattcccaactgctgtccttcatcactcactttgaattctcacatgactacatgatattctgattctcatacacgccttgcattctctcacttctaggcctttgctgctgctattccctcccatgttatatctccctgaacaactgcggatccaaaccccaccagacttttaataggaaaaagccaaactctctctttctctctctctctctttctctttctctctctctctctcaatcttcacctaagtgcctaggccagtccaagtactcaataagcagtagttgaataaatgaaagaatatggcaaattattaataaggttatctctggaagttggattaagtaagaaattagctattttctttttttctaattaaatttgtagctaactaatatagaaatctatttttttcattagaacaagctaaattagaaaaatctgatcaagctaaagtctcctttgaacaaattctggttccttctacaaagaaaatcatacttatgaatttggtgtatatttttaaaactcttattttatgtttttatatatcttaatatgtaagcatatttttgttgttgatattttataggggaacgtgttaaaaccaagtggtaacatttggtgcctgcaactagttcttctaactttacaatatatgttgggatctatcaactttgatgtgtgtgtgtatacacacctatcttcagtgattctcagtggtggggtgtaattgacatcatgaacaagacaattcttggttcttcaagactgtatcatttgtaggatgttaagcatccctggcaccctctcacaaaataacaatagcaccccgactccctgccctcattatctggcaaccaaaaatatgctcacagcttttcaaacacttttggttaactttttacataatctcatccttttagcactccactttatttatcatctccatgtcgatggacatttaggatggctctagatttcttactcttacaaacaattctgcagtgaacacccttgttcatattttcttctgctcatgtatgggtgtttcactaggtggaaactagaagaggaatcgctggtcatatgtggaggttcagttacaccctatgtgctaaattcccctccaacttagacccttatcaacaatggacagtaatagccattgcccaaattctccaatacttaatactatccaatcctttcattataaccgatctggtggataaagaaaaatatcacattattattgtaatctgcatttctctgattaatagtgagattatttatttgaaacacatctttcctcttctgaaaaacacatactttatcttctttacatgtatatattttaacttttactatatatgctttataatcagaataaaaggtaacacaaccttaaaaaaaaaaaaacaggttatatttcaaggcctatacagatgttggctcattcagggaacctgatttcgatctttctttttagaacatcccttgggtactttattctctcttggatatagtttgcaatatgcttgtcttattctcctgactagattaatggttatttgtcacccagtctgaggcttttccatttttgttccctttgacctgcctagcacaatgccttgcacagatttgaagcaatgactgaaggcagaaaaggttgattatgggaaaactaccaacttaactctatttttaacttttatggacacagtcttgaatcatccttatcaaaggtggacatatttctacaaagaatacaaatgtcattaggatatacattcactcccctgaaagaaatgctcatcagaatgttccaggaaaggaatgcttaactcaattaaaaggggaagtttaggtttttgtggaaaagctatttggggaatgaggatccttattgcaccactgacatcatggaatgtaggtggctgcctggaaagctctatactgggcttgcccaggccctggagtctgtaaactcctgaaaaggcaatattgactcaggcaaagctgccaccaaggaattgcagtctccaagaattttccagactgcagcttagtgtgattcttcttgcattatactcaagtatttcttatgtgtttatggtatatagttattgttttttaaattatcattaaaacattattagtaaaaactgttatcaggctataattagacgtcaaaagaattctataaatgttttaaacgcaaacttccaattctattgaaaagaatccaaaggaatgtccaaatcctttaaatgttttggaattttgcgaatcaaatattgctttacataaacaactgttatcaggctatataattagatgtaagaagaattctataaatgctttaaacacaaacttccaattccattgaaaagaatccaaaggaatgtccaaatcctttaaatgttttggaatttcacaaatgaagtattgctttaaataaacaatctgctggctcgaactgaaacttatgctgaaatgtttattataaagttaattattggcaaaatatatctaagtttttataaccttgtggaaatttcacctatcaaaaagaattagaattttggcttcagttgaacttgaactttattattgtttcacttataattcttccaattgttctttgaaagcattttgtagtgaacagatttgaacttgtctgggaatcagttcaatgaatggagctgctttgggtaaatagctctgtgtttattcttataaaatgtgtttcatgccattgctttcagctagcaaatatatttctaatataggatgaaagcatctctgccccaaagataaaatatgctaagaaacatgcattaggaaatgcagatttagaaaataggtatcttggagacctatgtaaaaacttccttccacaggtgcacttaggtttactctttattactcaggctaaaagtttatgccacagggatgtctcagtggatatcagtgtggttcatgacaacaagatcccttaatgccagaatagggctattcctcaaagcttttttacactatacacacctctttaatagcatttagttcatcacactgacattatttgtataattgcctgtctctctttcatcttcactgacctaaactgtggtccctagcagtcagcaactgcctctgctgtctagctttctgttatctgatctaaataaaaagtaacaaaaattctatttgagcaataagaaagtcatgccacagagggtaaattgaaagttacggctttttggatctcaatggcttcctggtagcaattaacgcatactaagcactgctttagttgccaggctttatggagcacatctcatccatgttaatgtgtgcaggactcacaactggcctatgccgtatgcctattagtcatactattttaaacatgaggaaccaaagctcagattggttaagtaacatgtccaaggccatacagctagtaagaggtaccacctggattgggacccaggcaaagcaacccccggggccacaatcctaatcatcacatttcatgcctctatgacatcgtttaaaagaatgtgaatgacctgttattggagaaaagaaagatggtgcagagcaatatgcctagaaaataaaaataataaataatgctcgtatgtttgtagaatcaggagtggaggtacacatccaatgcctctaagtgtgtagactatctcttaagaggaagcacaggaaaatggttaccaaggtgtcctctaggaaaggaacagggagcctgagggcccagggtgaagaaaacatgttttgctatgtctccttttggacaatttgaatttttttttttttaccatagatatatattaccttttctaaaacacaaatatcattttgaatctccttgagcattccctagctcttcagatacttgtcaggctgaaacagtacttggtggcatttacttcatactataattccttccatccagcttcgtttcactcatgacaatagcctttagtattatagcacagaggtttcgccgtgaaaaggtaccacacttgaaaaagagtgtgagagaccaaaaaaagaaggaaattggtcaaagcctattcttatggtattttgacttggactttaaaaaccaattctgattacaaagcaacactgtattagtttgctagggctgctataacaaagaaccacagcctgggcagctgactataagaaatcgattgcctcacagttctgaaggctcaaagtcggaaatcaaggtgtcaacaggattggttccttccgagggccgtgagggagaatctgttccaggcctcttcctgtggcttggaagtgactgtcatgttcatgcgctgttctccctgtaggcaaatctatctcctgattttccctttttacaagaggacaccagtcatattgaattagggcccaccctaatgacctcattttttttttttttgagatggaattgcactctgttacccaggctggagtgcaatggcatgatcttggctcactgcaacctccgtcccccaggttcaagtgattctcctgcctcagcctcccgagtagctgggattataggtgcctgccaccatgccaggctaatttttgtgtttttaatggagacggggtgtcaccatgttggccgggccggtctcgaacccctgacctcaagtgatccgcctgccttggcctcccaaagtgctgggattacaggtgtgagtcaccacacccagccatgacctcattttaacttggtaaagaccctgtctccaaacaaggtcacattttgaggtactgagaggttagcacttcaacataagaactttcaggacacaattcaacccatgtcacgctactattagtcaactctgtgctctcctttcagccccacccagggatttccttgtcctaatgttggggctgagagctgggtctctgggctacttatcttgaagaatgttgctaggtaatctttgcaaggaaaagccagtgcagggggagtcatgccatggtttggcctgagtgaaagcgctgttccctcctttctaggtggtatcacggcaacctcacacgccatgctgctgaagctcttctcctctcaaatggatgtgacggcagctaccttctgagggacagcaatgagaccaccgggctgtactctctctctgtgaggtaaggtgcttcagggctctacgacttcagcatgggctcctctgtcacttactgactttatcatcactcaaattgccagacagcaaaacttcccaattcctgttggaccaccaggttaaaggattccaaactctaaatgatgagggtgtaaaacaacattcctgctccattcattagcaggaaaaaaattgttagagctggaggagacatgaggaattatttgatggaaacctttcatgggactgttgaagaatctgaaacccaaagcggtggaatgtctggtacctcaaaaatcaacaatagaaacagtgccagaatccaaattcctgacacctggctcagtgtccttttcactattctttgatttctctgtaaatgcagaatgatttatgactgtacggctttcatagtcacaacctcaaggaggcaatatacatgtttaaaatttttcctatagtgggctagcttttcatattgagtctctatttctcccaaatggtaagaaagttaatccagtccccaccaggttcatacagccaaatgcagtcattgtccagatctttcaggtcctccccacctcacacccccttctttctgtctggtgccccagatcagagaggctgaccaagcttctggtagtcaggggaggcggctggttctcagtcgcatctgacactctggcttccactgacatgtagcaagtattcttgggtttttaggcgcttctccatggattaggcaggggatgtaaggactccatgaaatttccctcagccacccacccattaagctcaaactgttattgtgttactgttctgatggcacctccatataccctggagagtcactcttcccttcatagtgcagttcctcaagctaatctggcctcagaggctctctcacttctttcccagtctacacggtcactactggtcactaactcagtagcagcattcacattgtctctttgggctctgggccttgcttctatattcattttctatgctacataacaaattatcaaaaacttagggacttaaagcaacgcaactggattatctcacagtttctggctggattctctgtccaggatcctaccaggctgaaataaaggtgttggagaagcttgtggctctgatctggtatttagtgtcttcttccttcattttctcctttcctcttcatcctttttcatccattcccttgctgccgtagaactgaggtcctccttttccttttagctgtcagccaggggccattctcaactcctagacgccacccacagttctttgccacatggcacccatggctgtttaccacatgggtgtttgctttcttgcatgccagccagaacacatctccctgactttttcttctgtgagcagccagagaaaactctgttttacagggctcatgtgattagttcaggcccactcagataatgtccatatcttaacatcaactgacttgggactttatgacctgctaaatcccttcccagtagcatgtagactagtttttgattgaataattgggataaagtgtgtgtactccaggggctgggatttgggatcatcttagaatgctgcctgccacaactcccattcctggaacagtgaaaatctacaggcctacttgaagtgggtgggtgtgcgaaacaggtagagggtgatggggtaagtaggggtcacagaggaaaaacaagcatattcattaacatttctcatgtcaccctgttatattttatttataaattttctgaataacatagatgaaaaaattattaatccaagatggaattctgtttgagtggcaacaagaattgtgctttctctgctcaacagcaaatgttaaaagttcatctaatggttaagttgtagatgctttattgcacacatcagaggtcctcaacctttttggcaccagggacaattttgccacagaccggagcagcggcagatggttttgggatgattcaagtgcattacatttattgtgtgttttatttttgttattattacactgtaatgtataatgaaataattatacaactcaccatcattcagaatcagtgggagccctgaacttgttttcctgctactagatggtcccatctgggggtgatgggagacagtgacagttcgtcaggcattagattaacatcagaggcacacagcctagatcccttgcatgtgcagttcacaatagggtttgcactcctatgagaatctattgcctctactgatctgataggaggtggagctcattgagaatgcaaacaatggggagcaactataaataaaaatgagcttcgctagctcacccatcactcgttttcttgctacgtggctggcagggggatggatggggacccctggcatgaatcttccaaaaatgaaaagttaattaacttttcacctatgtatgtctcatctgagcaattagatcataagctttttataaatcaatgacatacatatttcatatacataaaaaataaagaataaattattgattttcattgcaagcactagagaatgcttattaaaaaaatgaccagcagaggtgacaaaaaccacagactaattcaggagaatgactatttttgttttatgaacaaatattcacttatttgttcattcttttaatgatgaatatttgaaagcatttattctgcaccagccactttggtacgtgttgtagaacagtggtccccaacctttttggcaccaggggctggttttgtggaaaatgcgggttcaggatgaaactgttccacctcagatcatcaggtattagattctcatgaggagtgtgccacctagatccttcacatgtgcagttcccaatagggttcaggctcctgagactctaatgccatcactgatctgacaggaggcagagctcaggcagtaatgcttgctcacccactgctcacctcctgctgtgcggcctggttcctaacaggtacccagtctgcagccccaggataggggatccctgctgtagaagattgaaataccttattttggggaattacagcctcacagagccaaaaagaccacatacaagtaacatactacaaagtagaggttgacaaataacataaaagaaagcaagataagtgtttaggtggttcagaagggaaaaagcagttaacttaagctggaattatcatgtaatacttgacagaggaggtggtacttgaactgcaccttaatgagtggctgggatttctaccagcagagacaaagagaaagaccgtttcaggaaaaaggaacagtatgaactaagggacagaagtggaaactccttgaagagcagtagatccagttggactagggcagctgttctaaaggtgtggtccccagaccaggtgtgtcacctaagaacatgctaggaatgcacagtctcaggccccaccttggatctaccgaatctcaatctgcaggggtggaggtggaggtggcagcaagctgggttctcacaagcccatcagatgattctgaagcatgctaacatggtagcatgggctgcactgagagtaatagcaggaagtgaggctagaaagatagaatgggatcaaataaagtggagaggcagatatatatatatagatatatatagatatctatagatatatatagattagatatctatagatatatatatagatatatatatattgtttaatactctgcctcatttcaaaaatgaagtggaaaatgacaatgtaggaaatttgatattttattcagtaggcagtggaacatgcacgggaggaaaagggctaggctcacgtaactaatcaagcgacagagctgaattctgattgactcccaaacaagcaagggagaaaagcccaaggcagaggagagtgtggtgagggtgtcatatgtcatttctatcattcctattctctgcccttcttaaactcatgccccttagcagcataatgttcaaggactcttttggtaagtctaggagtagatagggagaacagtctcttgtcttccattagagtgaaaagttgaggctgggcgtggtggctaacgcctgtaatctcaacactttgggaagccgaggcaggaggatcacctgaggtcaggagttcaagacaagcctggccaacatggcaaaacccagtctttactaaatatacaaaaattagccaggcatcgtggcagacacctataatcccagatactcaggaggctgaggccagagaatcacttgaatccaggaggcggaggttgcagtgagcctagatcatgccactgcactccagcctgggggacagagcaagactctgtctcaaaatagtaaataaataaatgaattaattaattaataaaagttgaaaagagcaaactctgccaaaagaaactagtgatgctatttaaaactgtcagtggtttcaatgattgcctaattctcagttcttataaagggttaatagtgatgctaacatctgagatcatatttcccttcaacaagatatttatttgttaaataatattaaatacttctttttcccttttagggccaaagattctgttaaacactttcatgttgaatatactggatattcatttaaatttggctttaatgaattctcatctttgaaggattttgtcaagcattttgcaaatcagcctttgattggaagcgagacaggtaagctatgagcagacacttgacttatgaaataatgtttcgggatggaggagagacaaggcagatttcaatttaagaatgtcattgttgtcatttatatttcagcattatcttgaagagaaaacaatgtattttgtataaagtagatattttctcagaatgtgttacttaatggattgattaaaagcacacaatttctttaaaatgggctcaccattttaaaataacatatacaatacacacaaaaagaacaaaggtaaaaatgactttttgattactcataatttcagatataggcagtttgcatatgagtgagacccacagaagtaaattttgagcattttaaaaactaaaattcccacttaaatgttcacagagatcactgaatattgaaaatattaactaggaagcactctcctaagttataaaattctgtttctattgtcacggttttttaaataagattttaagctagacttaactatggctggaaaagtttgaattttcctgtttgaatggttagagaattaaaccagaaaaaaattcatgtgtaaagaaaaaaaacacaaaaaacagtctatcttggcacttgaattatctaagattgaacatcttgtttatttatattattttaatgaagtaaaatatcatccctgtatttgtgatatagaatcacaacacttttgtcctaaataatgataaatcttagttaatcaaagactaggaaattccaagaacctgcggcacaagaggaactcaagacttaataacacaaccagttaccatgagtttgtacatacgtgttttcttggcaaacttgccagtgggctttctgttaacttcagtgtgatgggaagagatggcatcattggcttctgtcttttctgctatttatgtggtgtgggtagtccctgatgtgactcacacagtgtctagtatacatgaagtgcacagcggaaactagaaaatagttgctctgctttatactgaccacaccaagcccaagaaagaataacccaaactacgaaatgaagttataacctttttttccttctttctcctggtataaattctcccaatcaaccctgaaaattacttcaccatttaacaagcagttgttcccatgaacaaatggccagtggaggtgtatttatttccactgctaccttggccttggcaagcatttcagtttctcaaatccctacacttcagtctcctttcctgcttgcatccaattccacacttgattttgttcagttattggtcactggccatgtagaggagatttttaaagccagggttttgttttgtgtacctctaatttttgtatttcatatccgccaggtcctggcccactgcagggcattttgggtgaataaataaatgaatacatggataactatgagtaagaactctttgtagtcttcaaagccactagagttgtcatttttctactttctctttttcttccaaccaaagacagctcccttcttttaaattcttctcctagactctattttcaacttctttgatcattccctgtgctccttcctgggccttctccaagttagggaaaagatacatattctgcctactggcagatttcaaaacatttaagatcaaagtgaaggcagtgctttctggttgaacctttctggcactgatccaatcatcaggcaagaggatcacctaaggatgcgccaaaataaagatgttttgatattgcatttgggacaatgataagcttccttgtaaatacactgttctgagtaaagaagccttatgattgatgcattagggattgtaaggatttgtcatccagacttctacagtagtttctctaaaactcaaacctgctgtattattatcttgactacaattgccattttatttattacaatataactcaggaacctaatatttttatcctctccactgcctctcctctgttctattcattatccaatgaagaatttgctgctgtttgaattcctgctttcggcccctcgtgctgatggatatgcacttgacttgctggcttccagcccttgagttagagtccaccagctttattcctcttatctgtcccagccagatgaagggaaagccatcagggctaggaacaacaggcaaaacccatgacagatgagtgttcaaatcttgcccctctgggagtaataggccttgggaaacaagataatgtgctcaagtcatgatgacttgtaagcccagaaattcctcaaggttacggagtcagcattgcagactataaagaatggtgaatggaaactgacatgccaccttctaaaaataggccttttcttcttgttcatttaagcatgggctcctagtattggctcccagtgatcagaagatcttcaggctaacgatttcatgttcaccttcagatgaagtacagatatttctttctttttttttttttttttgagacggagtctcgctctgtcgcccaggctggagtgcagtggcgcgatctcggcccactgcaagctccgcctcccgggttcacgccagaagtacagatatttcttatagcttatgtttgattaacatcaccaggaaaagcatttgtccacacaatggacaagcccctcccagggctctcaacttcagattaccagaatgacaaggactagaattggatatttcaggccactgctctcagccagaccccacccaggcccagcctcaccctgcagggtctagagggtaagtttattaaagagtgactttcttataatacatttatctactggcacaagtggtattacctttgagggcaacagaaatgatatccaaatagccaaaactttacacttttgccttgcagttatatataatgccttcagtagagtgaaacccagaatatttgattttgggtcgtaagaacatttttgcactcaaaatagataaaagtgttgacctaaggggattaatgctattttaagatatcttttttttctattccctactctttacacttttaggatttctgtttgctaatctgaaaagcaaggatttcctaagcaacatctaagcctcttgacaactttaagagtattttatgataatttccctttcccttgccataatctctatttcatctctctaatctccattaaagtttctgttcactctaatttctttttatcaatacccataaacactcttaagatacttccaattctcaaaacctaataatttcccaagtacatgatagagatatacaatgtactctcttgctttatttttctcaatggcccttttaccttctgacatctataattcacttatgttttttaaaaaaatacctttttttccacactagtgtgtgaactccatgaagaaagggacttttgtcagctttgcttcctgctatgtcccaggacctgaaaaaataagtactgatcatttccacaatatgtcatgctggatgccccatttccaatgcctgcattgcagttttttgcatggcaacatcaaaactagcaaacttgtgacaattttaactttcaaagtttataaaaacataatttgaaatgatattttgtgttgcatgtatgctcagtgatgattaaattcagaatttgcctttcatttgtgatagtgttgcaggacttttccttagttcagctaaagatcgggtccctctccatcccacggccacaaaaatttaggctcgcagacggtttgaagggtgagtgaagcagggttttattggatgaaaagaaagaaaagagggaaacagggaagctagagcgcttcctgcccagcagtttgaattctatgttcctcacaggaagaggaggggccaggctcctccccactgcaaaggacacgaacttcctaaggcttcacctcagtgggcaggccggttggagtttttctgtctcaatagtaggatatcaaataaaacatattcatgtctgtgcatgaactctaaactaaactcaaatagacttgaaaatttgagaaacttttttattagtataaatatgtttggtccattattaattttgtcgtagcctcttgtaattagctaagtttcatatatatagtcttgaaaatgtagacggcatttatctttatgcttaaatgtctaaatatgattagaacaaaaaattacttttaccattaccttttgtttatgtttcaataattcttaacatgaaattgccatgtataatttattacattgtattgtgactgtaatcacctaacaggcatgaaaaaatataatacaagtcaagttctatgtttgtgcttaccctttataataattggttcccaattttaaagatctcatctggttttttggtaaatgtcaaatctccatttctctttttgttttgatatggggattcccaatcttttgacgacagctaccgctattattattttgttttgtgacaccacccaggtgatatttttaaataatgtggttaaaattaattttaatttgagaattgggtggttcttcagaaaacaactagtgacaacttagaatttttccaaacttccttggatgtttgccaaaaatacaaaatgttctcagtttatagatgagttttattcgaaaaaggaaaaagcagctgaggaagggaattaagccaacatttttagagtgtttgctaggttccaggcattcacctacatcaacttatttcatctcagccacccacaataatgcatacaacggtcctattttcagatgaggaaaggaaaactcagaggttttaagtcacttgcccaagttttcactgctggtaaacatcagggctgagattggaatctgggctaatctggttctaaagcatagatgctttccatgcaccttgctatcttttgaaactggtcccacaataacagtacattgttgccatggtacagtgtggccttaaatggatttggaagaactcagagctgagattggaatctgggctaacctggtcctgaagcatagatgctttccaggcaccttgctatctcttgaaattggtcctacagcgacactgcaatacattgctgccatggcacagcatggcctttaataaatttggaagaatttctgctacaataatgtagtagaatgattgtaggatatggcagggctgtaacacatgtcttagtcctatccctcagtctcttctttatctcttctttaaagtctacaataacatgtttggtacatgaagtaaacctattgttctaaagagtgtgaatcaactttaacttctgcctttgtatttattgttattcccattttatttacatgaattgctatttcagaaattataccagaggaaactttaaaacataaaaaggctgaaaagaaaacatccccctaaatatacaggctcatcttagtcatgtgtcttcagcaaggatatcaaacagcctgtctaagtataacaaagtaaaataaaatttacagcttgagagagaaactgaaagaaagggaaaatgagaggtaagatcaaatgacagcaggaacaaagtatttcaaatgaatattgtacatttacaggaagcagtacaagcatttggtaatgaagcttctcgatgtttttttccccttatttgggcctgtatgcttagttagatttacaggatgttagaattgaaagggagctcagggactattgcatttttcctttataaatgaagaaactgaggcctggttagaaatggggaagcaaaaactcacatctcctttctcaagctgcctcctaaagaatcaatttcttcaaactttgatttatacatgtcaactcttgcccacaatacagcacagtatttcacatgccctagaagtttccatggtgactagattgaggctgagaataattatggtataatgagtaaacacacaaattctaagtttcaactccagcctctgccatttgccggctctgtgtgtctcctcaggtaagttaaataatctctctgagcttcagtttcatcatcttatgaaactgattagatggtagtagctcatactttaatgacttattgtgaagattgaatgaaattaggcacataggacatttggaatgattcttagcatagtataagtattcaataattattattcatatttaataaaatgcttttatggttattaattccatcagattctatgcaaaagctgtacgttctttgataaataataaagaattagtttagggacaattgaatttgcatttatcaaatgtttgtgatgtcctcttcaaactttaatctagttccatagtggactcatataagtggtagaatcaagtgagcactccaaaaatagtgacttgacttggatatttgaacagaattttctcctacactgactaactggtatgtctctcctagttcagtgcacttcaccctatgagactggaaattaaatattaaaaccccttcacatgtaaatgaacaaggcttaaagtccatttgcagagcaggtggcaaagaaggaaggaaaaagatcttgaataaccctattctctcccaccaaccccaagaaatctacttctcattggaaggaggggagagaggaactcattatgccagttgcagagcttattttctgaacctgagggcagtaatgaaacacggatggacatgatctgattttaatttaattcaacaaaatgttttgagtgaaatggccctgtgagccactgataacatagaaagataaatcagatattattcttgccttcaaacaccttacaggctagctggggtacctgatgaataagcactgacctcactgcataaaataaatactctaaacaaaagtttttctttaggagttttgtgtaccctgtgctacactctatttcagataccaaaccaatgcctaagaattgagactgttcttactctctttctgagttcctgctggaatacaagataaagggtccttcaatgcaatttcatattattgcatacagttatatatgtaactcttacacataactgtaagttaccattcagtcaaagtaaatggaaatgcctgccttggtccagctctgatcatctcaaaaacatacctccgctaagcatggctgaaaccaggtttcatgtcaaaggcaggaaacaatagtcacctttacgtagttcagaaactgaagtgaaacttatagccaagtttccaaggcctgtggttactggtcttcctcattcttcttgctctgctacccctgcctcctgttgcctttttctaaatctcccagctgagtcctggagttcatttggtctgaatctcagtaacccagggtccctttcttcccgagctgaggcactaacttggaccttggaggcaaagtattaagagtctgtggtagcgacagtagataagtttgtttgtttgtttgtttgtttgtttgttttgagacagagtctcactctgttgccaggctggagtacagtggcgccatctcggctcactgcaacctctgactccctggttcaagcgattctcctgtctcagcctcccgagtagctgggattacaggcatgcgccaccatgcccggctaatttttgtatttgtagtagagacggggtttcatcatgttggccaggatggtcttgatctcctgacctcatgatccgccccctcggcctccaaaagtgctgggattacaggcatgagccaccgcgcccggctgataagtttcttttgattggaaatgacagaaaccagctctggctagctgggtttttttggtcttgtttttgattttgtttttaagtgagtagggtacaagaacagggaacaggagcagaatttttttttttttttgtgatggggtctcactctgttgcccaggctggagtgcagtggcacgatctcggctcactgcaacctccgcctcccgggttaaagggattctcctgcttcagcctcccaagtagctgggactacagacgcatgccaccacgcctggctaatttttgtattttttttagtaaagacggggtttcaccgtgttagccaggatggtctccatctcctgaccttgtgatccgtatgcctcggcctcccaaagtgctgggattacaggcatgggccaccgcgccctgcccaggagcagaattttttaaaaggatattaacaatataccctcccagaatttaagggcaagttgaacaaccaagagacaacaaggaatctgcttagtaatcatggcaagtctgaggctttcagtcaattgatgtgtctgtcttgattcatctctgatcgtctcagaagtgtacctccgctcagcctttctgaaaccaggtttcatgtcaaaggcaggaaacaatagtctacttcatgtagttcagaaattgagttggtggaccttctctctagagaagcaattaagtggatccccaagaagtgaatccaattagtgtgaccaggtcaggtattcgagggccgggccaggtctggaggtataacatggttatagggaacctatctctgtatactgggaggtacaatctctgcagaaggggaaatcattaagcctcacagccatgccaagaagtctgtatattggctcttccttgggcaagaatagtcatctaaggagaactgtcttttaggacaccagatttttatcagtataagttgccgttttataagtactttgtcatcttcatctcacaatttagtttagcctcatttgtggggttactagttaaaatcaatctacagtcagttttactctcttggttgactcaatgccattttcctttgttttacttttgttgaattaaactttagaggaggttttcaaaatagaatttgggttcctccaacagagatttgaaaagttatgcctgcggttattgtcctttcttgcctcaggcctggagaattgtggacctgggaggctggttcatcccaggttctttcttggttcaagcctgcattactgtagcattcattcattaattcattcactcatctgccttcattatgtcagaaactctatcaagtggtagggatacaaagataaatttgactgataggtgcgctgaagaggctcacagaggttggaaatgcacacgttggaaaggcagtggctgtctaataccaagaggtgacagcactgcaggctcaggcagcagcccagcccagagatccttaccctgcagcgcaactggccccggtggctatttctcctccagggactgatactgtggtaggaggataatgcccccacaggacgtccacatgtctccctggacctgtgaatatattgttacatggcaagagggaattaagtttgcagatggaattaaggcagctgatcaaataactttggggtggggagattatcctagatggtctaagtaagaccactgtaattgacagggtcctcataagtagtagggagccagaagggagagaaccagaaagatggcagcaggagaaggatctgactggctgttactggctttgaagacagaggaaaatggccacaagtcaagacatgagggcacctctgaaagctggaaaatgcaaaggaatgaatcctccctagagcctccactaggaaagcagccttgccagttttagactagtgagacccatttcgaacttctgacttccagaattgtaagatgataaatctgagttgttttaagctgttatgtttgtggcaatttgctacaatagcaataaaaaattaggccaggcacagtggctcacgcctgtaatcccaacactttgggaggccgaggcgggtggatcacctgaggtcacgagttcgagaccagtctggccaacatgacgaaaccccgtctctactgaaaatacgaaaattggcccggtgtggtggtggatgcctgtattcccagctacttgggaggcagaggcaggagaatcgcttgaacctgggaggcagacgttgcagtgagctgagatcgtgacattgcactccagcctgggtgacagagcaagactccgcctcaaaaaaaaaaaattaacacaggtattattatgtgaagtgtgtgcctggtcgtatcaactaagtacatctttctggagtgtcatttaaagcattattttcatattaagtattaaatatatgaagtagaatgaaaattaagcatcaactttgaagataaagtataagagttcaaaatgtatctaatttgggagctgctttgatccctaggcttcagttcccctctcctcttctgtaaggtgaaagtgtttgagaggcaccaatttaactatagttaatcacaagtagtgattactagactaccaccatttttattcctagcagaatgttgcgtctaggtcttttttaagatttcaaaatccatgtccccaaagatgcaatcattcaaattttatttaaggatttaaaaatattctgtcaaagaataataatatctaatatgttatcattctcccacaaacatttatttggtgccttctgaaggaagcataattattctcactagtaaggagcagaagcttgtaatggttgtccaaggccgataagtactgaatggcggtagtgacaattgaaccctgttcctctgcctgtgcatccagtgctctttccaagggtccagagtgactatgaagcacatcactgggagtgtttcttagggttgggagccagcgctgaatttaccatgcatctacaatgtgagcactgtgttcacagagcccctgagcctgcacagcagctactcttgatataggtactgctgctttcattctgactgtaaaactgtagccggccccttctcctcatatgactggatctgttcttatgggaagatcacattgacaaaagagagcacaatgtgcaagaatgggacggttctgataatggcaaaatctgtttttcattgtgatcccaatgctgcaatgccaatgagagacagaaagaggaagggccagaggctttcattcttctctgaggtcgagatcagacaccctcttctggcttttctcaacagcttttcattttacagcagcaccttatctgggcccaagtatcaaaagccacagttctgtttttgcagtcagacattgtatgtattcaagtatcatagacaggttttgttttgtgtagttttttttttttttttttttttttgagacagagtctcactctgtcactcaggctggagtgcagtggtgcgatctcggctcaccgcaacccccgcctcccgggttcaagcaatttccctgcctcagcctcccgagtagctgagactacaggtgcctgccaccacgctcggctaatttatttttgtttttattttgtattttagtagagatggggtttcactatgttggccaggatgctctcgatctcctgacctcatgatccacccacctcagccttccaaagtgctgggattacagatgtgagccactgtgcccggcctgttttgtgtagatttatcattaacattagggtgttttttaaccacagaggagacatttttctttttcattttctcactcttactctaattcaggttctatactctccagatctttcaaatcttttcaaagacgcccttcctgatgacccttgtaaaatatcaccctctcccaaccctaccttttctattctctatccctttaccatgccctattcattttttccataacacttctcacacataaaatattttttaaattttttttctgtctcctctacctagaacataagctcgataagagcatttaaactcctttgtgtgctattgcattcccagtacctagacaagtgcctggcagagtgcaaagctctgtaaatattcgttgaatgaattgctgaattctttacatctcttccatgtctggtacaatcttaggcttgctatagaaaagaccctagtaaaattaaaagcaagaaaccatagcaagaagaaaaaaaatccccttaagttgcctctttttgtagttagtttctagtttctgattgactgattgattgagggaaggatttcaagaaggaaatgtcagaaacatagactcagaactgctctgagcccttggaacaaagttccccagccccccatgcctggaccccctgggctgagccctttttctgcctggaggctcccctctccagatggaaggggaaggaggcaatcacttgtgagcaccagcttgttcaggtcatgttcacttagtaatgcaaagactttgcttggttactttcattaattgggtagtatcagagagtagggagaatgctcacttttttgaaatccactaatttgttacacgtttattcggaaactgattgataggaaataagggcaatggaatggatcttcctctaccctagtgcttttgtttagtcttgttctcatggctttcataaagccttcctggaaaacttccagttactacttaagatctaaatcaaatgtcacctcctttatgaaagctgtcctgaatcctttcatggaaaggttcttcaagcagtctggggatgattatcatgctttgctcacacggctgccattggtctcatcaccctgttcatttaaacgaccatatctgttaccagttctgagcaccaggaggccaaggaacatctccatcatgctttatatctcagtgtccagcttaagtgccttatacctaattggtatttgataactgttgagataatgagcgagggaatacatgaaaaaaacaaaagactttccaatccagccacagttatccagttagcatttggaccttccttctgggaacactgttcgattatatatttttcatcttcattcaggcactctgatggttctaaaacatccctacccaagaaaagtggaagaaccctccatttatgaatctgtccgggttcacacagcaatgcagacaggaagaacagaagatgaccttgtgcccacagcaccttctgtaagtgaccttcaacgtgaccacaagctctctccctgtctaaaatcaatcaagttcaataaaagttaataagagtgtatttgttcacataaaaattctagcttggaatataaaacttggaaaggaatgtgagatttgaagcctatgactcagttcatctggtcctgggtagatcataaaaattacaatgcagccagacatggtggttcatgcctgtaatcccaacattttgggaggccaaggtaagagaattgcttgagcccaggagttggagaccagcctgggcaacataaacatctctacaacaaactttaaaaaatattagctgggcatggtggcatgcacctgtagtcccagctactcaggaggctaaggtggaaggattacttgagtcaaggaggttgaggctgcagtgagctgtgattgtgccactgcactccagtctgggttacagagtgagaccttgtctcaaaacgaacaaatgaaagcaatgcaatagtaataggattttaaatacttcgaaaatggaacttaaatctctgtccttagttaaccaaacaacttcaaagtagaatggaaaagagaagtttgcattcacatagttttctaaactgttttctcctacaattttcttatattaagaaaatatatttttttaaatatttcaactatctatggaagacaaatattctccacctttactataaaaactcagggtattattttttctagctttttttcctttactgactgaagtttacagacagaaaacacttgtgcttctttgcaacgtgagccattgttcaatttcagtgcaattggagcactcattgtttgtccaagagtccatttatgtttgttctgtgaactgtgactctgcagaggttcctctccaacacccttttcccttcattattctgaaggcccttctatttgttgtctcttccttgtttgctgaatactcctggtataagaaacctctatttgggcagatgataaagaagataatacccaaataaatatcaagaactaattctggatagtaatcatgacacttgaaaaataatcacttgaagatattcagctacaaattatattaaaataagtgtaactttctatatctgcagtacttttctctacccttgaccagagagatctttcttaaaaagaaggcttgccacatgacctctgctttacatcctttggtgatgccttttgtgttcatggcccacctggaccctgcttgcctctctgtcttcatctcatgctactcccacactcacactgtgaaacctgtctctctcaacattgtgctctttctcctctccctacatctgaaatgctgccaacaccattgctatctactcatccctcaagactggtatcacggatcattatcttccaggaagcctttcttcacccccactagcttcttttacaatgctcctcttctgtgctccagagcaccctctgtttgcctttattctaaaattaccatgctgtgggctaattaccttcacatctctctgccctccccaccagccagaaacatctaagtacatgaatcattgcttgtccttgcagctttacagcctagcctggctcatggcacatcttacatattcattgcagtgctacatctcctcagaaataaaaatcctgaaaattgactgagaaagttattttggctttgttagaagtgggggagaaggcatcaagaactcagaacttgagaaatttaggagtgcaagacaataaatagtccaaaggcagaaaagaccaaagaacaaatcaagatctactctgcaaccaattcttgttttccagttgtccagtcccttcataatttcctctttacccacccttacccttaatatagatcaccagtcacttcaacatctctttcatttgccctgttagtttaacttcacattctcctctgctacacttcccctaaagatctccactcaaggtcaaacaaaccatgtcctattaagcgtgttctttatcggcaataaaatgcagataatacctaatttgtgagattggtgtgagcagaagatatagtatccttatgcagaaataaacctctttaaagcacattctggaaaccttgttacttaccttcttttctcactccagctatcagatggattcacctcttttaaaatggagtttttaaaatagtggtgagtgattggttgacaatgacttgaactcacactatataatgacaagcttatgaagttgattgtacatcactatggacaaaaaaaatgtaaaggtttcctagaggatctgaaatgtttctcattacttctcattggggaatcattggtgactggaccagtatagctgctggggaaagagttctggtctgatcagaatgctcttgtcccttattgaacacaagttctaagccttcatttgctaccccaaatggctacatgatgctgcacctccatctccagcctgagagccctgagggttttcaaacttctgcattttctttttggggtgtagttcttgctcaaggtctagcagtggaggaagagaattaaaagaacttcttgtttgaagcgaaagtgaaagatgccccactgcccagaaatgcagatgactgtgtataactgtttaacatcttttagtaactgcatttggggaaattgctatttatgtcttataaacaacatagcattgagttcccatgataggattaaatttaattaattcatttattaaacaaactttttttttttaaagtgcttccaatacactcagaactgttttaagcactgggagtttggcagtaattttgacaaaggtcctcctcccctcactgagctcacattctagtgaagatcacagacaataatcaatgcagtaatctgataccagacagtaatacatcatgaaaagaaaaagtaggataaggggagaagagggaagcaagggaggcctctgtgaggaggaaccattagtaagagatttcactgaagggaaggagtgactcatgtcaagatgtggaaagagtgctgcaggcagaggaaacagtacaaaggccctggagtggaaacaaaattgaggtgcttcaaaggctaggaaggtcagaattacgggatgaagtgagctagaggaaaagttgtagaaggtgagattattgaggtaatgaggggtcagatcacataaggcaatggagttttcaaagagcagcacctcccagctgagcatttagaaatatgagtgtttctgttggtgcattgctttgcggcactactatcatgcgtgagtgtcaagagccatgaagagtctgactttactctgcttgcaagctaacaagttagcctgctgcagtttcatgtatgctgatggatgacacaagacttctgggtaagcgttgaaaaatagtttgctattcacaggaagagcaacagccaggatatcagtatttatgctaattccctgtgctgagccgaagttcccaaagggcaatattgaaagggccaggtgatatccacaatgggttgccctacaggagaggaaccctgagccttgggaacccaaatcttttctaatgatcagtagacatgtcttttgttctgaagggaaatatttctttattccaaggctgcttgtataagcatactttaaatatcagtctgcagcaaagaactgttaatgccttgctcataagacatttggaaccttgacaagagacccgtggagattatttcccaacagtgatcaggggctaactattcttcaaagagtggtagagaattatcttgcccaaaatctcagtagtaccttttgtacataacatgagaattctttaccttctgagcttgtttaaaaaaattcttgcagatggattgaatgtgatacacgaaagaaagagtagcagagtcatggcagagaagccctgctatttactgagaaggctaactctgcaggaggggtgggttgaggggatgagaaagaagagctctattttggacatgttaaatgagaaataccaattagttgtcttggtagagattgagattaatatagttcaagttcctgacataataggtcctatctaaaatgttagtttccttagcttcccttttgtggtatttgacgtttttaacaactccctccttctaaaaattctgtttccttagctttggcaacatctttctgtctttattccgtaatctttgacacattttatagttcctcttcttggatactttccttgcacgttgcccttttccagtattttgtttttgaaactcttctcaggtttaacattttgttgcttatcctttcagtcttttacttgaaaaaaaaaagtatatgtatgtatatacacacacacacacacacacacacacacacacacataaaataatgagctcttcattgtagagttgtaatattcttgtttaattaactatatatttaaaatttttttcatgtaattacttagttttctggaacaccattaaacaaattccataatattccattatttgagtatatcaatttattcagttaatccactattatgttttaacatgcttttttatttgaaataatgtcaaagttacagaataattgctagaatagtacacagaacttggttttccccaagtcgtttgatagtaaattgcctacatgatgccccatcaccctgaatatttcagtgtgtatttccaaaaataagggcatttgcctgcgtgaccagatagagccttccaaactagaaaattaacattgaggctgtgccactgtttcatccacagatctcattcaagcttcactagttttctcagtaagttccgtcagagtaaaagatccagtcctcaagcacaagttgcacttatctgtcctgtctctggaagattcttcactttggaacacttcctcagtttttccttaatttcgtgactttgacacatctgaaattaaagaccagttattttgtaaatagtttcccaactttggtttatatgatattgaatcatgattagatacaggttttttcatgttggctacaaataccacaaaagtgatgctttgtttgtgcttctcactgtgtcttctcagatggaacacaattgcaatctgtctcataatggtgtgtttgattacttaagtggtgtctgccaggtttcttcactctaaagtcaccatattccctttgttattaaaaaatgtttggggtgaggttatttgagactataagaatattctgttacttattaaatttttacttgccaattttagcatttactgatgtgtcttggctgttttaatcattactatgattgttaccaaacgatgactctctgattttcttattcctttttacattcattggttgtcattctactgtaaggaaaagctttttattcttcaaaattttcaatcatttttatatcaaatggttataatcatgactatcattatttattttgatccttcaaaatttccctgatttggccagtcggggaaagagccctttcaagtggtgtctgtgttcatatgacctcaaaaaaaattttttttttttggagacagtgtgtcactccgtcactctgtctcccaagctggagtgcagtggtgtgatcacggctcatgaagcctcgacctcctgggttcaggtgactctccctcctcagcctcctgagtagcagggactacaggtgtgtaccaccactcctggctaatatttgtattttcatttttttatttttttttgtagagtcaaggtttcaccattttaaccaggctggtatcgaactcctgggtgcaagcaatgctcatgcttcagcctcccaaagtgctgggattatagttgtgagcctccgtgcctggcctggcctcaaaattcttttaagaactttcttactttctgaatagcaagatgatccagacttatcttgttctttctttgtacccagctctagaaccagctatttctccaagaaactctgctctttttccacagaatagtactctagaaatcgacatctaggtactatgtgcttattgttatcaggatgtcactctcccagcccactcagtgagcagagctgggaaaatatgtatgtatatacatatgtacacatatatacttttacatctgtatttatctgtcgattcattcatcgatccatgagttcacaacaatgcttccaataccacaaagttcattctagtgttttcccttctcccacagtgagaaaatatggatcttatcatcctcagtacacttatgtggtgatcaattgaatataagcaatctcccattgctgtttctactactcaacccttaccccgacactccaaccacccagtcatgcttcaatgctcagttccaggccactgctgctcccaccctcactacagatgtccacctagcccaacttggctctgaaactgtgcagtagctgccacctccaccccttcaggcagaagccctccacaccctgccaggcttcaatgcctcgcacacagctgctgctgccactgtcactgccagtgtccacacagaggctccctgtgccctacttgggctccaccaccctgtactaaggtgcttgaaagccctccacacacacatcaatgcctgccttgcttcacctgaactgtgttggctactgacttcatttaaggctggcaggcaagtaggtagtaggatggcaggaaggacagtcctttgtttttgaacatttagatggtaccccaatgggggctcttataaacagcttttctgttacagttcatagatttttaaagataaatgtgctctataattatttactttcttacatctggagaccctgaataaaattaatagtctcattgctttcccatgcagcctttggcttacctatcaaaaccttagaagaatactacacttatagtacattgtttgggtggaggtaagatgggattattccctagcttgattttagtaaataattctatca

SEQ ID NO: 560 - DNA, 45995 bp, Homo sapiens
tatcaggttcactgacatctaaatcctatatcctttttcccatctcttgtaactgttgcaaacgatctaattcttcagctaaaaaacaatttgcagttccttaaatgaaacactgtactgtgctttttcttgcctttatgactttgcccatcgtattccttctcttttgaatgtccttttcctgtctacctggcaaacacctactttacttccatctcaaggcttccattttaagacttctaactcattcttccctcttgacccagactgggttagatggcccttatctatgctgttatatcacacccaggacttatctcattgttctccaaatatctctttgtctcccctactatactgtgagctccttgaaaatagggattctgacctgttcatcttatattcacaatccctagtgcacaatggacatttgataattcatttattcaacatatatctatgaaatatttgctgaataaataaatgaatgaatgcttgggtaaaatttcctgtaacgacaggtaataaaatactacagacaggtaataaaatcctaatatggcttcactttggaaccaagatacagttttaaacaagagagcctattgtccaagctttatatgatgggtgattccaagagatggaaaagactactgagaacatgctttttctattgcctctcttgtagaataacagcaacacgtatgaatctgaagtggaaaagttcccttttctgtagcaacggctcatacccagctcagtaacttccttacaactcttcttcgtggctaaattttttaaatactaaaaattaaaatacctgttctaaaatattcttgaggtgagaataggcctcttgtggggtgaatttcagttccactatcaagcgatcaatcttattaatcactaaaaccggacggatgttttcaagccaagcttgtcgcagaactgcctgtgtctgataaaaacagaaagaaaaatgtaaaactcatgatttgaaataattagagcacattagaaaatcgtgattaataaccactctagactatgccagtcagacaaaggtattcattaggcattcacaaactatgtatacagcggagtagcaaagaactacacataagaaatcattgttgcctttatgcaactgacagttaagaaggataaataaggccgggcatggtgggtcacacctgtatctcagcactctgggaggctgaggcaggtggactgcttgaggccaggaattcaagactagcctggccaacatggcaaaatcccgtctgtattaaaagtacagaaattagccaggcatggtggcacatgcctgtaatcccagttactctggaggttgaagcatgaaaatcacttgaacccaggaggcggaggttgcagtaagccaagatcatgccactgcactaaagcctgggtgacagagcaagactctgtctcaaaacaaacaaaaacaaaaacaaagtatgttaaattaaagtcatcatctctaagatcccttcagaactctggtgatttaactccttcacagactggaacgttaccaaatgtgaaatataaaaccaatgttgtgattgtcagtgaaatgcctaaagtcagtcagttccccctctttcctcacccttaaccatttaagtattttctcatcacaatccattacctgtggacagactccttccacagcatctaccacaatgatgcatccatcacaaatgcgaacagcggttgatacttctgaggaaaagtccacgtgtcctggagagtctatcagattgatcaggtactcctcattacctaaaatacaatttgtaaacacacattttcagttgtccaggtacacaatgttcttcctcaggcgttctagaataagaaagctgaaagcttctaagaaaaaactgaacaaagctaaaggagttgaaagctcaatccagagctaccattccaacttttcccactgatgggactactgattccaaatagcatctatataaaatgttaaaggactttattattctaatagttaccacttaagagcttattgggagccagccactatgatactcacttttaatgtgctaatcacatattattgaatccttacaatatccctatgagatacatattactattctccttttacaggttaggaaattgaaactgaaagaaatcaatgcctaagggcctgacagtaagagctgttcaaagggccaacaaagcagttggccaagttcttccctacagtttgtcaaagagcagtgtatgaatctgctcaatcaagatttagactcaattctacaaaaacttaaggagcagttactatgtgccaagcagtgtgctatgtgctctcccattaatatctccttcaatagtctcaacagacaaatgtattaaacttatagtagggtgatgacacatcctgagttgtctggttttagcacggaaattcccacatcctatcaaagcccttagtcccaggcaaacaagaaaaaaaaagatcatcttaggttatagagagttatcactaaacataacttagtataccatgcagaaaattagttaatactttagaattctgtactcattccccattattgataaatttgatataattctcttttaaaggcagaataactattagaatgctcaaacatatactttacttttgctcctccccttaactcagtgtttatcaacttgaatgcactcaagaatgactacagggttgagtatcctttatctgaaatccaaaatgctccaatgagcatttcctttttgtgccatgttggtatttgaagagttttgaattttggagcatttcagattttggattttcagatttgggatgctcaacctgcaatttatgggccatttaaaggattttcccccaatataattttaatgacttcgcttgtgccctaggtgatactgatgataaacaccaccacaacaataaccacaaccagcgcttaacatctgtggactgcctattcatggctggcattgttctaagcataatacagaaattatctgatgtttacttacaacaatcccctgtagtagttacaactattagcccaattttatatagcaggtaactaaggcacagaaaagttaagtatttttctcaaggacatccagctagaatccaattctgaggttgactaagatcacacaattcaaaatgatagagcataagttcaaatccacttaactccaaagaccatacctctaaccactacactcagaaggcagtaactttcacctcacatgccaagattccactgctaatgaattcctaaaacactgggtgaagcattcccaagtgtactgaggctcagtgggaaagactgccatcagttagcaacagactgccttcttcagtaccactcctccccgctgcctcctggtcttttcatgcaaactgctttatgaggaaccattgctctgctgaaaccaccagagaaggctccaaccagagaagaccatggagatatccagtgaaaatccaagaagtcaaataaccagagccctggagcaatggcccactggacctcaatcgagcctttcactgtcagatctcacaccagttctcctagtcaacattttcgataagtatcgtgatctcaaccaagtacaccagagaaaaaggagcatgtctagtagtggtctagggtcctatcatacaaaattaaagctgtgagattcttagaatcactcagcattttctcagcctaagcctttattccatagaaaaacatgctaacgccctcaaaaggtaagagactgacccaaggtcccaaaagaagcaagccagaaatacacccagggctatcgaaccatcttagtcacttctcgggtcttagattccttcatactttgcaactggggaaacaacacttgcctattcatctggctaaactccagactttagagtgggagaacttcaagcacttttccatcctttgtgatacgaccgggacctgatactgaagtttcagagactgggtctccagtcaagttctttacagagtctaaaaatgcactcgtacagacatttcaggcttcctatacaacagtgctcttaccttttattggagttacagaccttttagggaatagtcagaaaaacgaatacctatctacttatctatgctcccctaagtacgcgtccatttccagattctttgaaattcattcaggaagggcaggttcagatctagagaggaactgaaagctagagatacaccaagtgtttccacccgacaatctacatcctaaaaaataagtgtctgatcaaataatatagctgagaaataaacagccagccttggagctcacatcacacatacatattaaaggttcagagaagccctgtaaaagaagtttgtccaattctgtttaacctggagtttctcaaatatatttaatggtgagaaggaggaaatgccatggtcagttacacagctgacaaaggcttggctcagctctgagccaggcctcccaattcctccttcaatgcctttttcatcttaaccctttccaaacaacgttaacctaaatttcaaaggttggggacagaagtcccatatccattagagaaaaaacgtccccaagcacagctcttctgctgtgacttcagccacattatgtctctttaaaaaatgccacttaccacttttgcgtgtgtgtgatcaaattaaaaaatacataaacgcagttataggggtttaccatggtagatattattgttattgccagtattaattatttaaaaagtagagaatgcataacacttttcaagagacaaaattttttaagcatgctaaatgatctttccgatttgtaacaaagtcctgaagctatatgttgaattaatccctgcaatagcattcagggacagaaacttctgctgctttacttcccaggcattccaaactaaacggcttcatttcaaggcacagatctaatcagtcaagcaacaatccaatctttttatgttccagggggctgaaaaaaaagttggaagaactgaagttaattatgggagatatcttccagacaatttctgctgctaatagggagttatgggaaaagaattcctcccttgcccatggttttaaagtgccatggataattgtctcacagaaggtgcacatttgtcactaggacctgccaaaacatctctgtattcagtaaaacttcatgtaaggagtttagtgttcaacttccaaaacactggaaatgctcactaaagcatacatagaaagctgatgagagaaaactttccataaaataaaaaagaaaaactgaagttatggaagaagatctgaacctcctgaaagtgtcctttatgtgtcagtgtattggtagagtattttgcctgacaacaaaaataacagaaatataggcagaacctgagttatctgaagacatgttcctacattccttatgtatgaacttctaacaattatatacaaaaattgtaccccaactatatataaagtaaccacaagtctccctccacaggaaatactacttttttttgttttttgttttttttagagacagggtctcactgaaacattcaggctggatgcagtggcacaatcatagctcactgcagcctcaaattcctgggctcaagcgatcctcctgcctcagcctcccaagtagcagggactgcaggcacacaagggtaacttttattttttgtagagatggggtttcactgtgttgccgtggcaggtctcaaactcctgtccctaagtgatccttctgcctcagtctcccaaagtgctgggattacagatgtgagccactgcacctggtttccttttatatcttaaatcactattatccttttatattttaaatcaatgtataacattataagttataaatcaactaatacgacttattatttgacagaactgtaaagcacaattgtaaagctgacacaggtaacagggtaactatctttatgagaagcctgccacaaggagaggtgaagggtggttgactctgatagtatgtgtcaaaactgagatggggtcaggcacagtggctcatacctataatccaaatgctttggaaggccaaaacaggaagatcacttgagccaagaccagcctggacaacatggtaagaccatcatctctacaaaaaaatttaaaaaattagccaggcatggtggcacatgcctgcagtattagctactcgggaggctgaggcaggaggactgcttgagcctaggagttctgggctgcagtgagctatgatcaccactgcactccagcctgggtgatagaatgagactcttgtcttaaaaaaaaaaaaaaagtgacaggggttaggaaaatgagaggaaaaatgatctagaaacaactatgaatagcaaactgattaagttttcttttgctgcacaaacccgacccgaagacctctccagaccttcctccaacatgaaactagaccacgtacagaccacttctgattacatttggcctcacccgcttttggtttttctcagtatgatgccagtccacatctgccacccagtactgtggccacaccctgaactctgacatcactgagaacttctccacctttcaaggcctgctgcgtagatagtaaatctaataattacacatccacattgtcttgattcctttgatcattggcagttttgcttggaagggtgtaagaaccagaataagaaaccctggagtaaaaaaaaggttgatgtttacttcttataatctctctatgcttagcatcaccctggagagaaggtcatagatcaaggaccaatttcacactgctaatgcatgtcattactgtaaggtgctagtctcattatcggagtaattgagagagtaattgtaggataactttgactaagaagggggaagagggaaaatgcagaggaatgtggggctgaaagaaggatttatgtatttttttaagacaagaaagacaagaaagacttgagcatgcttaaaagctgatggatacaagccagtacagagggagaggtggaagatactgaagaaaagatcattaagtccagagcacaggtttttgccagtgacaggaggcaagcaaaaaatgcccataccattacgttttgagatacagtggcaagcaggtgagaattcttctcttttctgtgaaatagaaggtaagaatgtctgctgagattgtggaggaggggatgacaggtaggctgaaagagaccagaaggtttaaaataggtattgggaagaatgagcaagacctaacagtgagagatgggaaatctgccagcagtctggaggaccacttgagaacctagcccaaatgcaaggatgaagacgtgtagagaattagctttatcaagggttaaagttttgttgggaaaaatatgacagaaggtcaagaaccaaagagactgaagacgctggcaagactgtcagtgaaatgacaaatctgggctgtatgaagcaggaaatgaatgaagaaagaggctgtggggagtcaaaaaaactagagaacattatgaagtcaaagaatgggtacctcattaatcaggtgaaagaaagagctgggagaatcaaagattgtagagaaggaagtatttaagtttgaaaggtcgaagatggatagctcaaggtgatgctaaaatccagaaagtattcatgacaacaggtaggtgaaacgcagaatcaatgttgttgagaggataagctgttgaagaagtcattctcagggatggtgaaaagccaccttagaagattcaggtaaaaagaacaattatgagtccgggtgccaaattcactaatgaacaggaaccatcaccaggagctgacaatgactggaaaggtgaataattggatggtctgagtcttgaaagaagaagtttgaaaacaagggtagaagaattaacttttgtaatcagatctgggaacaaaaagaatggcaatcccatatgctaacccagagatacgtggaacatgaatgaatgagtagcattcacttggaaaaggtacaaggcaggcaatgtcatcagaagacagccaggcagaagggggaaacgtcaataaaaagacattgaggatgtagcgatgtttgtttctcttggaatgttttcacagtaagttttggtaaggaagggaataatgggaaattgaaagagggtgtcagaatcacagagaaacatggggaagagactataagagaggccagatcatgtggcttgcatcgtgggcagtgactgaagaccacagggacgtaggtagtgttggccacaagacgtgcataacaatccctagtggaaaggagataactcaagcctcaggaggaattagttgtggcctgacttccaagagactaatggtccaagtgaatatgctggaaatgtgggttctaggactactaccacatgctagaaattactctgtccttgggaaagtgtcttcacctctctgaactccatttttgcacatgtgtaaaatcagagtaatacccatcacagagttgctgtgaagattaaacaaaatcaggcatatgagacacctagctcagaagtgaactatcgtgtacctagtttcttaggcctggcatcaactgaatacttcacaaagtaaagcattcattgtctgacgagaacaaaatctacccttcagtcaaatgaggggtaatggaactcttccctcccagcctcattctggaaagaataaggcaagttaggaccatgggtaaacgttcacacagccagaggaaaagggaagctactgcctctgaataagagatgactttctgctacatgctggccttgtctgtaattagatggcatgagtcagtgtctccatggcctagtcttcggagtataaaaccagagagccacagagctgaaatcaacacatgcgtaaatcctccttctgcccacaaccactaaccctatcctaacagaggtatttacaaagtgatcaacttgcatatggacctctttgcagaagactgctatatccttggtctccctgtttggaggacaacctcactgcatatggctgactcttgggtgaatcccaagtgtaccactgaaccaggctattagctagactatatgcctaaggttactaactaaaagctcataagctaaagcccactgcagtgttttccatatggtgttttacaatttttaaataagttggcagcattttgatacttggaagattttaccgaaaatcctgatgccaacttttcttgaaaaaaaaaaaaaatcactcaaactgcctcacttatgcagaggtgtcaacaccatgtcaggaactaataatattgtacttaataatcacatctgacaggtgttagaataagtaagctatttggggggagaaataaagttagatagttacctcacagtgtgtgcatacacatacaacttgcattaaatataaaaattgaaaatataaaataactggtgatgaactgagagtgatttttatttcatttttgtgttttactgtatattctataacacacactaaattttctatagtaaatataaacttgggccaggtgtggtggctcacaactgtaataccaaaactttaggaaataggtagaaggcttgcatccacgaggttgagaccagtctgggcaacatagcaacatcccatcgctacaaaacatttgaaatatatatataaataaatatatacattgaaatatacatacatatatactatatatgcaatatacctaatatgtatgtatgcatataaacttgtaaatttatttaaaatattttaaaagatgaattagataaaaacttcaaaagttcagcaacagcaatatttgctcagatataaaaaatggctatacagtagaaacgactgcagtattccttttgatgaatttcaaattatttaacccatgtgaatctatttctctcttctgtatctggattctaggctaaaggattcaaaggcattacatccccttaggatattttacagaacgtatattgttaggaatacttcctaactcttgagatgacaagataaatgtatggtatccttgtgggtgggacacaaagagaggtaagaaacaggcaaataacaagatttaataatatgatcccaatatttgtagcaaattttggtcacaaacgtaaagataatagaggttccattttctcaaagaaaaattaggttcctggaaaatgctgagatagtgtatgaccttgatggttttcaacaccacttctataatgtgcaggatttatctgtttactttaaactagaataagaccctatatttcaacccaaataaatatttgaaaatacttttgaaagctcggtaaattaagagtcagaaccacagaaagggcttaacttgcatttagtacacagattctcaaataagagggcattcgaagtgggtgagaaggaggggaaggcatggtataaataaaagtcacctgtggagtttcttcaatcatcaggtttccctctttttctcccatctaggttccccttcagacgtcccaccttcagaacaggaaataccccattctggagaatcagtactaagatacagataaaaacatatctcatctctcaagtgctctgagaggatatgtcccagtcaacattcctaacttctatccccataaggctctgcactgtcaagtgtgatgactgctcggcccaaattcccttctaggcagtaatcccatgctcacaagaaacatgtttgacactttgtgactccactccgatcaccactgattggattaggaggtgactaaccaacccaagcgcagccaatccataggtgcaacctctgtgatgggctggcatgaaaagataagcagagccgcatcctgctcttgagcctgtgtgctcagaaacacaagagattgaagcagtaggcaacagaaataaggtgaaaacagacaggataatagggtaagaagtcagggcaaggtgaatgtacaaagatgaagacatgacagtaggcaaaagctatgagacagagaaaagacatacaggataatagtggaaatacaaacagacacccaaatccaaggacaacagtggagttccagaggaaggatccataaacttttactgatacggtctctagagctatcttggatccagaataaaaatctggctccaatttttatgagacatcactccaataagactcctgtttttccgttttcatgaatattatttccaatatcatttcacacatatgctttcaataatctatcccaccccaacccaagctagcttaagtctctggtctatgcaatcaagaaagcatacctggctgggcgcggtggctcccgactgtaatcccagcactttgggacaccgaggcgggcggatcacctgcggtcaggagttcaagaccagcctggccaacatggtgaaaccccgcctctactaaaaatacaaaaattagccgggcacggtggcatgcatctgcaatcccagcttcccaggaggctgaggcaggagaatcgctggaatccgggaggcagaggctgcagtgagctgagatcatgccactgcactccagcctgggcgacagagcaagactccgtctcaaaaaataaaaaagaaagcgtacctaaaacaatctgatctgtgagcagccaaggtcaaggtcacagagctcgataaaatagagttcagaccattcagttcccagggtcctatagcaaattctcctacaatactacaccagaaagataaatgtgaattggaacaggtgaattttatggtatataaattaaaccttaataaagtggttaaaggactcaagggagggggactagagacaaagtatagagcagaacaactaaaactgacaccagaggaatcttcaaataaaaacagactaataatctgagtaaggaagaaggcagccttcaaatctcttgaagtctataaaacgagataagaaatcaatagacccttaacctcattctctggatcacaggatgagaatataacctttaaaatgtgagaagtggtttaaaaaaaaatgaagcgttaaacattaaacatcgagaaatcatgtgcctaagagcttcaaaactggtttggtacaacagccatgccccacacagtacatcttttggtggcagtgtcaaagatatgacacttgtgaaggatgaaccacatgtaagtccattagggaaataaaatttatctttattattttcttctaattacaaaaatatacattttgtgtaaaattttcacatactacaaaaataaatattttgaaaagtgcaagtttctccataatctagcccctgcagagagctactgttaagggtttggtatgtatccttccagacacctttatctgcatatataatatatttttattacctaaacacattcatatcttacaaaaatactctgcaatttgttttctgtctctgaacataccattttcccctgtacaataacatatatattaaacatttgttttaacagctgcacagtatttcactgcttggatatatcagtttattgaaccattctcctattgacattcaggttgttgttatttttttcacgaatacaaactttttagtgaatatcagtgacatgtatctcatatacttacatgactatttctgtcagataaattcctagaagtgttactatcaatgtagcatcctcatttgaggacagcaagctggtactgatcacggcagtctacctttaatctactccaaatctaacatgcaggccaggccatgaggcagaatagtaaggctgaaccagctaaagtcctagggctcctgactttccttgtgaaggaatccatataatcacctggtggagggggcaggtgtgaattgccagttcttctgccctcaaaccagtcagaggtttccatctgcatccaagcctggacagcctgactctgacaacagatcatgtggagaggccagaataaaatacgtggaatataagcaaagaaactgaggcatgcaattaattcagaaagacagaagaggacatgaaagatgcaaagctgtgtttcgttaaaacacagactgatttacctgttgcataatgtagggaaatggcactggatttcatagtgatccctcggatctgttcatcttctctgctgtccatgtaccttaactggaaaaatgcaacatatgcatcttcacttcccaaagaattaaaatgtaacattaaaatttgctaatttagatttttgttttaaatacttatatttaatttgttatttttatttatttttgtagagacagggtcttgctatgttgcccacactagtcttgaacttctagcctcaagtgatcctcccaccgtggcctcccaaagtgctgagattacaggtgtgaaccatcatgcccagccaatacttaaattttaacctatatagagccttttttttttttgagacagagtcttattctgttgcccaggctggaatgcaatggtacaatctcggctcactgcaaactctacttcccaggttcaagtgattctcttgcctcaggcctcccaaacagctgagattacaggcatgtgctaacacacctggctaatttttgtatttttagtagagacagggtttcgccatgctggccaggctggtcttgagctcctgacctgaggtgatccacccacctcagtctcccaaagtgctggcattacgggcatgagctaccgcgcctagccctctctcttttttttttttttaagatgatgggggtctggagaagtgaagttgattgaggggaagggaacatgaaaaattgaaaaacataaccactaggaaccataaatgtattgaaatactgcataccctccccagagtgttgctcatccaaatatcagccgtgaatgatggggcaggtcaagaacaacttacggacagtagcatttgagggaattctttctaaacatcaataacatagccattcttttcctatttataagctgtttgacaaattctgagcagagactgaaacagaagtctctagaagcaagagaagtctttattcctttcccaaattaatagattttgaatacatcttttttaaaaaaagaatacagtagaaaatatttgtaatatgaccatttagttgatgactttcataacactgtaatacccaccaatgagtgtctacatctcattttctaggccttgcagtgcatcagtactgacagtggtgtcgtttaaataaagatcccatccctttccaactccttagccctaagcaccagactaaccttctcctcctttctccagaatgattttcccttacccttcctccattctctccactgtcaaacttttgaaaaattcttaacctgtctattttctcctttctttcattcaaaagcaccaagaattatctgttgatatgaactgccacatttattcatccatattaattctgaaattttcagaaaagcttccatttccacagctctggcaaaatcaaagtcctaaaagctatcaatgacctctggcgaaacgcaataatcattctcaatcctcatttttcttgattccagtgcagcatgacagttaccctttgtgtgcatgtgtgttacgtgcatatgtgaaattcttccaagagtctgaaacctcttaatttacctccatctctccttagatcccactgctggtttcccttcacctctccaacctctcagtcagtccttccttcagaaagtctcagtcccttgtcagttttctataatgtatgtttttaagcactgaattggtatgaaacgtgtaatacataaataacaacacaatgaacccctgtgtatgcaccatcccatttcaaaaggaaaaaaaaaaatgtttgttacttttgaagtaccctgtgcccctggcttacaggtaaccactatcttgaattttatcttgatcatttccttattttctttataatttttaaaaatgagtgtgtcactaagcaatatatcatttagagtggcaagttttaagccttctataagaatcatacttaatatattatactgtcactttttctctgctcaatattgttttcctgagattcagccacattgacgtaatttattcatttttattactgtaggactccacctcacaaatctaccagacccattcgtccattgtagagaatgaaggaagggtaagggaaaatcattctggagaaaggaggaggaggttagtctggtgcttagggctaaggagttggaaaaggatgggatctttatttaaatgaaaccactgtcagtactgatgtacttcaaggtctagagaatgagatgtagaccttcaactggtgggtactgatggacatggagactgattccagttttttgtaactattactgagttgatatgaacagttgtgggtctcttgtacactccctaccagtagaatttctgagttattaaatctgcacatcctcaacctaacttgatatttccaaattattttccaaattgttggactgatccacagtggaatagtgcgtttcttgatccataacctccacagctgatattgctggactttattttctaagtaagatgggtgataaatagcatctcatggttttaaatttacatttatcctattattaatgggattaagtatccttttgtaagttttttactggccatttaacattccttttctgtgaattgcctatacaaggcttttgtccaccttcctactggttgcaatacagatttattttgttttggataggagttatttatagtctctgaatattagtcctttgtcaattatatgtgtgttattaatatttttcacagttaccaggcttgttttttccatttctttctggcatctttgatgaatatgtacttaattttaagtagtttattaaccttttataaaattgtttgcacatttttgtcttaagaaatcttcctttaaggtcataaaaatattagcccatattattttctaaaagctttagtttttaaataaaaaagcttttaaataaaaatgtcttaactgtgcaatttgtgtgtggtgttaactagaggtccaatttttttttccacagggataaccagttgcccaagaaccacttgaaaggttcatctttttcccacagatctgaaatgccagcctactattctgagccgtcagtcaatttcatgcctcagccgattccaggccacaggttacaacacatcaacacattgataagtcttgccagtgggtaagatgtatttccatatcttactcttcttcagtcccggctattaattggtttatttgctcttctgtatatatttttaaatcagcatatcaagttgaaatttttaaaaatctgttggaatttttactggaattgctgaatctacagatcaatattttttaaatgtcatttaaaaaatagacagccaatacgtaaatatggtatatccttccatttaagttttctccaatatctcataggttttgttgttattgttgttgtttttgaagagatggcgtcttgtgctatccaccaggccggagtgcagttgctgtcacagctctttgcagcctcaaactcctgggtttatgcaactgtcctgcctagcttcccaagtagctgggattacaggcatgagccaccatgcccggcacaggtacatttattatgctatttaaatggtttacgtttttaaattactgtatattacctatttattgctcacgtatacttcttttcaacagttttcgtatcctgaaacctgccaaattgttactaatatcctagcaatttatctacatttttgttttcttcctttccaaaattcacactttttatttttctttccagctttatcactgcaactagaacctccagtacaatctaaagtagaagttataacacaatgagcagaagggtgtgacagccattcttgccttattcctggctatgaatagagaagttttaacacttcatcattaagttcaatcttcattttaggttttttataaatatcccacatcagattacagaagttctcttctgtaactacattgcaaagaggttttatcacaatagatgttgaattttactacatgtctttatatctgttgaaatgatcatgattttcttcctttaatccattaatatagtgaaattacatgttaaaccaatcttgaattccttgggataaactcgatttggatatgaataatcatctttttatactatgctgaattgtttgttaatgaggatgataatttttgcatccataatcataaggttggtatataattctcctatattgtactatccttaacagacttttggtatcaaagttatgctatcttcatatgatttggagaatactgccgattgttgggtttttctctgctatattttgaaatggtttaagtaggactgaaattattctttgaatgtttggcagaactagagagttaaaccatctgggtctttactttatggaaagatttttgccagccaattcaatttcttaaatgactatagaataattcaagtttcctatttcttcttgactccattttagcaagttatgttttccagacatttttccattttagcacttttaagtttactggcacagagttgttcattatatcctattattaccttattaacttctgcagcatttttctttctgggtatcacatatttctgcctcctctcttttcttcttgatcatcttgctggtgttttgtcagttgtgttactcttctttaaagtcattcattcaaaaatatttatttatatatactatgctttctatatgtccaaagtacagtgagccacattaggaacattaccaggtcaaaagtgtcaaatgttcctcaacaatgtcaatgaaaaacaaaacaaaaaagtttcctagtcaagagaatcaaaaattgtctatattgctagtaattgtttaaattaataactttatatttttagagcacctttaagtttacagaaaaattgactgaaggttcccacatactctctcctcccacccacacagtttcccctattatatctatcttgtattagcatatggtgtgatacctttgttacaactgatgaaccaatattgatgcattatgattaattaaagtccatagtttacattagggttcactctttgtatttgttagctgggttaatcttttccaaaaacaaacttctggcttcactgatcctttctataaaatgtctgtttactatttcattaatttatgctttactatttcctttcatctacttacttcagttttgtactttctctaaattctcaagtggggaaaatataagcatttcattatttcactcaacctagttttcttcagcctcctctagatagtatcttgggccagcttccctcccaacccacacatcaattcccaaatcgatcttcaagtctattgggtctaccctgtggattcaattttgcttctccgtctcctcttctctctattctctgtcacctgataaaccctattgatcatatcctaaattcattatggaaacgaatatatctttatttttctactgccaagtaaattattccaagccctttcaactcatagctacaaataaagatctctttaattttatttcctcaaacgctattttcaggctaggtgtggtgactcacacctgtaattccagcactttgggaagtcaaggcaggaggattgcttgagcccaggagttcaagatcagcctagggaacatggcaaaaccctgtctctacaaaaaattagccaggtgtggtggtgtgcacctgtagtcccaggtacccaagaggctgaggtgggaggatcacctgagcccaacagggcgaggttgcagtgagccgtgcatgatcacaccactgcactctagcctgggcaacagagtgagatcctgtctcaaaaacaaaaaccaaaaaacccactattttcatcacaatcctcaggcacaagcagctttcctttgatacttaggttaacttttaaggtcttctataatcttattctccctgccagtatgttttctctgtcactagtctctaggcaaacactccactcaaatagagcacaacacacaaattagcctttatccgtcttatttcccactacctggtagcttttctgtcttctcctcaaaccactcaactcattcacctacaaagaatctcttgcgctgtgaaatcttccacaatggtgtatcatttgcttgctgcaaaaactcacttttgcacttaggataaagcaatacaaagcaatacagaagtaactatttttctcctcagcatttttatcttgcaaaatggattggcagcttttagacgcaagaattatgttttatacccttttggatggctgaagaacacagaaaatggttcatcacattgttgatagctaatactgaaatgcaacaagtatttataaaataataacataccttgcctgctaggcggctggagatgattccattgctagatataagacagtcagccagagtagtttttcctgttaaaatagcaacatcaattcaaatctatatcttttttaaaaggggtcatggatcatacctatagatttaaaatctggtcataagaattggtttagtaaagattttctatttacctatgctaggtgacaaaagagatttattagacttttgaacagaatatcatctggaaggacacagaggctagcactctataatgctgtaatcttatctccaaccctgtggatctactcaacctcatctgaaaagttgtcaagtaactttagagaacatactcttttgccatatttccccatgcatggcctcagctggaatttgctaaactgtcttaagaaaatacttacttatcaaagaaattcaggaacattatccatatctcttactgtttgtaatatagcatgtggagggcataaacatactgtaacaaccaatgaaacctagtatccaaatctaaacctaggaatctactttaaagcaaaagaatcttcgaatatatttatagttacttttattaagcagactacatacaactaaagtctatgagattttatgtgatataaacaggtgattctgtgtaaagaatgtcaggggtatgcataattactacaactgggttggagtaagcaaaggagggtttttttccttcaagacaagtctttattgcactttaggaacttcagcaaagctatggaatctctgtattgttcaaaccagagaccaatgagtaggagaactgaagatatttaacactgctatctgtctgcaatgtaaatatgtattagcatataatcctagagcatcactttcctgctacccagtaaagctgaatttattctaagtacaccaagtatatacctccctagaaaataattatcaagcaagcaggaactttgctttattcacagcagtatccctaggaccagaacaacgcttgtcatatagaagaccttcagaaaatacttgttgaatggatgaatcccaggttttttaggatagtagcagcttaacataattttaaacaatacatttaaagtaatttgttacaccccactaactttccacttgaataaattcataaagaaaaaaaaaacccttttatcagccttcacattctcaaaatgtgagcagtaaaattataaaaactcatggaggcaggggttactcactggatttgtactaaaactcattcacagctggcttcacttgtaagtgatccactatctgtctttctgtcagtttccatactcacattacttcagctcttctatcaatgacaacagccacctaatctctgactttggatccatcctaagcatgtctaccaatctaatctttctcatgttttatttgattacatcattcctgctccatgttttcccccaaaggctccctactgcctaatagtagacattaatgatcgttttcatggtgaagcgtttaccttccctctcattattatcacatttaatcctatagcctataaagcaggtatagttttcatcctgttttacagatgctgtatattgaagctcaaaaaggcaaggtatgtaacttgaaaatggagatctgaacttaggttgtctaactccagagctggagcactcaactcttatcccagttcctagctggcatgagcagctctatgagatatgactcagcctgcttcttcacctcgccaactggtccttcatcttcaggatggtaaatatgttttatttcatatgcccatcccaatcactttgctgtggttacctaaactaccaagaggtttgaaatcaagaggaggcttagcatgaaggagcgctatggagttacagcagtatctgtcagaagaacataccatgggttagctatctctgcctttcccatatactgggctttgaccacatatatttccctctccccttgatgacacattcccacctgtaatgattatctccatttgtcatcttgagcccccttcaagtgtcatctctaatactaattatgttgtgaggtcttttcctaacccctcacttcctaatcctctagttctcccaaccttagagtctacttttttctcttgtttgtctcattttgctctgctccccgttaaaacctcccctgggctagtgccctactcataaatctccaccttcagacatactaagcaaaatatcttgaacttaacagacgtttgataaatatctgatgaattaaataggatcacataccacagactctaaggacattatgtcaagactacagacattttatatgtaaagccatttcaaaaacaaaaaattcaagttctgctttaaaaaacaacatgacataatatatagaagaatgctactcactaggtaaccgtgttcatttcaaatgctttatagcaaagcaggcttccctaacatcacacaaaacttttaaagaaagaagacttgcttcttagcaaacatcactctcagctgtccacagcttcactccactgagacatacagagacacatctcccttatttatcaaaataagccatttaaaaagtattcttaccatggtcaacatgagccaaaacacaaatattcctgatgttggcagtgtttttctggagttgaatcatcttatccaaactgttgagcaccatgattacttatttcctgtgactaaaaattaaatatgtattacaaatggcccagaggctaaaggtcggggcaaaagaaaaaaataataataaacgctgggaggtggcaagcttctcaaaccccttaaaccaagaacccagtgaatgtttattgatgagatagaccaccaaggcctaagtccagttcgagcactaaagtcagtatcctaccacgattacacttaaggagtttgctcatccttccggatccaaaggctgcgatgaatcacgcagctcgaggggactgggtgcacagtgacaccagtaaccctgccggtggaggagtactccagtaaacatctccaggccaatgaccacgtacaggaagggttgcatccaggagggagagaaaatgctgaagaagatgctccctttctctcttcagtcttcccccaagtccctcattctgacattctcgctcgtcctcgcgcgaggtcaaatacccagctttattcctgcccatggagcccgaacaaagttttgggtcacgtgcttattatccaagcaggtgcactgccggtctttcattcctttctaaataaaaaggaaaaacctctacactacatgcccttcatttctgcagggtcccagattcgttctctttgaggatcctgggtccacacagacaggcgaccgccccggccccagacgggaagcggcactccggggaccgaagctcccagcccgcgctcggccccagcccctgttcccgcctcagagccgcagcgagcgggttcctccggcaccgcccaaaggctggcctaggaggttccagcccccagcgccagcccacactcaccggctgcagcagccccaccagccccgctccttctctcgggtcgcacccacaccgagagcttccgaaagtccgagagctctgcgggtccgacacgcccgcgcgccagggggcggggccggctgtcgctcgacctttcacccgcacgtctctgacgccgccggaagccggcgccgagtctgtcaccgggcatccctctgttgccttgactacggcgggcgctgtgggagtggagaagctgcaagtgctgaggcgcggtggaggaaagcatgggagccaagagtatgaggagctggtgtctgtgtcagatttgtagctgcgggtaagaaacggctggtgtagcggcgggcccgggcttgggagccgacctagggcctaggtgcacggagccggctcctcgggaaccctgagagtggccgtcccccggagatgaagggacgagggcgcagcgacatccccacttatcccgctccgcgaatactcgctcctcacccgcctgctacccgggggtaaaacgtttgttcgtagcccctgagactcccaatcaaggatgcaaagtaaaatgccacccgggccaggtaagtaatatatgtgaagccgcgacgggatataacgctggtgagtagtgggatgtgatccgactgggagagtgcatttccaccccataatcccccaccacgaagatgagaaagaacagtgctcaaggccctgagtctgcaacccatatcacattttctttcatctgtagctttctgtcctcccagccagaccatattcccattcccgtccaggcagcagttctttgggatccgcctgactgaaaagtcagtaagtagtccctaccctgaaatctagaatccaactgtgagtcctgcctaacaaccttccatcacctgtaaacacagtcctctccttcctcagcttcactattgacccagggattagatcattatttgctaagtaaatatgaacgttgtcaatccctggtgtatttgtaatcccattcaaagaaaacacctacatgttgatggaaagcagtttttttaatagtctcataataaacacagttcataattatatatagattaaaatatcaacaaattaactttgggtgtatgaatcctcagactggtgtgcaggagaaaatttttacttttctcctaatttatattcaacgcaagttcctttctcattcaactgtaaggaaattcagtcttcattatgttgagggccaccattggaatggcgtgattttacttcttgtttgtttgttttgggctgtggttgttagttttgtctttttaagggtttatttttattttttgacaatgcaataaatacacaagaagtatcataaaaatctaagcaaaaatatctataatattgtaaaacgccttcataattctatcttccacagataacaaatgttctttaagacttgttttacatatgcattgatttttttttttttttttttttgagacagagtctggctctcttgccaggctggagtgcagtggcgcaatctcggctcactgcaatctccgcctcccgggttcaagcaattctcctgcctcagcctctctgagtagctgggattacaggctcgtgcgaccacacccagctaatttttgtatttttagtagagacggggtttcaccatgttggcctccatctcctgacctcatgatctgcctgcctcggcttcccaaagtgctgggattacaggcgtgagccactgcgcctggcctgcattgatttttttttttttttaacaaaaaaagagaatattctgagcatactattctacaatccggttttttactatttacaatctcaccaacttccaatgatcatgcataaagaccaccctcattctcttaaataactgtatactattagcttatatgatatattggtcaaggttcttagttgtggataacgtaatctcctctggttagtctaggcaaaaaggaatttattaaggagtatatatatagttcacttggaagaacttaagaaatcattttcaaaataagcttccacaaaaattttaccacagaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctctccttatgtagctctcttctgaatcaaagtatcatgtgaatacacatagtaggtgaaacctaaattgtatgtggaacctttctgcaagagcatgggaaattccctattagcttttcagcttctatagtgtaagaagacactaaattgttatgagacacttaattgctgtgcttccaccacatagggatagaccattatttattgattgtttttgtaaacaccattacagaggaaacagtttttgggggtttttttgtttttagttttttgagacagagccttgttctgtcacccaggctggagtgcagtggcaggatcttggctcactgcaagctccgcctcccaggttcacgccatttccctgcctcagcctcctgagtagctgggactacagggtacccgccaccacgcctggctaatttttttgtatttttagtagagacggggtttcaccgtgttagtcaggatggtctcgatctcctgactttgggatccgcctgccttggcctcccaaagtgctgagattacaggcgtgagccactgtgcccggcccagtttttggttttttagtaaagctctagaatttagaaattgtgagtttattagaggtctctgattaaaacgcagttataacacaaaatttttttaaggttaatctttcagtttattttttgcacaggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtaaaatggaaggaataactacatttaagtaaatatttagtaactatttgctttacttatttttctctcaactcttctggtgtcaataaagttttctagctatttaaattgaactgttcagttgatttaagttgaaccaatctaatagtcaagagactagttaagtcacaacttgaaaaaaaaaaacagaaaaatgagaattaagttaggttgacaaagtgtgagaagaaaaaagggatataaaaagttctatttttttttaacttcttaaaatatctcatatttatctactttccactgtcaccaccacctagagtagggtgtctaatcttttggcttccctgggccacattggaagaagaattgtcttgggccacacataaaatacaataacaccaaccatagctgatgagctaaacaacaacaaaaaaaaaatcacaaaaaaatctcataatgttttaagaaagtttacgaatttgcattgggcctcattcgaagctgtcctgggctgcatgcagcccataggccgcaggttggacaagcctgacctagaggaatgcagtcactttctaagtataatatctgaatctactctagtttttgcagtttgatctgttttcaatacttcagcctgcccaaataattttaaaatgcaaaccaaaccctatcacttctctgcttaagatactcttaaactttcccattatctttaatataaaccagaatccttaccaaaatcatgtagaggcatggtttgctcactatttacttctctaattcattttcactgtagtgtccttttcactcttttatgctccattccatgggccatttttcatttccttgaaagtgccaggtttcccttgtctcagagtcttccaagatactgttttccctacctgtagttttccttccctctcctagctaatgctcattcaatctatagatctcaactaaattatcacttgaaaaagccttctctgagacttttcagattaggtaaaattcttctatgtaagctcccaaagcaccttcctgttatttatcattagattagtttcagtgtttcatgaaagcaggaactaagtctattgttatctcagcattctatttttagaaaacgaatacaatgcctactagcacatactaggtacccaatatttgttcagtgagtgatgaacaaaaatcctcttaagtctatacttttcatttggacttaccttttttgatctctgtatttttgtcaggtggattaagtattacatttactcattattttatttaaactgttaatgtatgtgctgtattcaaggtacaatcttagtgttaagtataaaaatgtcaagtttgtgaaccccaaatatctgagataggtgtcagttaatttagaaagtttattttgccaaggttgagggtgcatgccagtgacacagcctcaggaggtcccaataatatgtgcccaaggtggtcagagcacagtttggttttatacattttagggacacacacatcagtcaacatatatgtaagatgaatattggttcttccggaaaggcgggacaactggaagcagggagggagcttgcaggtcatatgtagataagagacaaatagttgcattcttttgagtttctgatgagcctctccaaaggaagcaatcagatatgcatttatctcagtgagcagagtggtgactttgaatagaatgggagacagctttgccctaagcatttcccagcttcacttttccccttagcttaatgattttgggactccaagatttatcttcctttcacaagttgaagttcctgctttcagggaactcagacatcatatttctataatttagggttttaaaaatgctctgtaatagctttagattttggtgttagttattttcatttcagatgcagctcattcttatatagcaaaggtggagactttccaacttttagtctaatatttatatttttaacatttcaggcattccttgcagtaataatattttggtgactctagttactagtgtaggggtatggctcttccatagatggaagattttacttagtcctcagattttggtatgcagtagtgccatctagaagtgttaaaattgcagactccagagctctatctaaaagagccagtagataatagagtgggtctcaggaaactgcatttttaaccagcattggtggtgattctgttgccactgattgagtgcagcaggtcaggcactggactgcttaatgaggatgacatggaacataaaacagagaaggtctttgctttactgttgtttatagtctgtgggaaagtccagaaataaaaatatcagctaaataactaagataattatggattatgataaatgagatgaagaaattgaataactggttgagattgattaaatgggaatggttgttcttttttcttcactttaatttattaatatttttttcttgatgccttaatggttcatattagagatttgaaataaattttacaatatttgtgtttattgaacaaagattttgcttttaaccagttctaaatgtagaaattgagaaaatttaacctgccatatctttcttttaaaaggctttccaattctggatttcccctgttgacttattcaagtaagccttaataatttaaaaaacaaaacaaaacaagaaatgtcccaaaggtccatatatgccagtaaaactaaaatatttgtttattaaagtgtcatctcttcacttagtaagacatcggatcttttctttatattttcactgggaaactagcagtatttctaagagtcataatctaggagcttgaaactcttgcttgactctctcatgttggctgtgttgactaggcagtagaaagtggatttatctgtacaaacaaagaagcattctgtacctttgtatagtacaggaagtgactgtgtaaagaggtgtctgaacttgtacaagattttggatcctttatagcagtacagttgtagctcacttagatgactgccagagttggcaggaagcctgccctgaacgagtaggattctagacacatcaaatgtttcaggatatatcagatgaataagactgcattcaccctctactactactccatagaaagctgctttgggtttggaggcatactttctgacacttaaatagtctaaccagagaaactgggacttctgagcttactctttgcttttcccttcctgattctctcacttcctgactgcattttagcctattcccctctagttcgtatttgggaagagcaaagaacaactcagatgtcttgacaagcagaggtatgtgatttctactactcttcatccattaaataaaaaattattaagcatttattaagcatgaagcactatactagtcacctggtatacagtggtgaacaaaagcagtcatgatctctgtgctgacagatattacaatctattagaaatggcaatcaaaacattactcaaaataactctaaaactgcaacagtgataaaatctatgaaggacaggcacaggtaccttgacaaccagaccaagagtttgactttatcaggggaatgagaaaaatgagtcaaaacctgaaggatgtcaaattaactggattaagagggggaaggaaatgcattccaagtagagagagagagtagcttgtagcaggaaggagcatggaaaggagaaaattgtcaaagaaagccaggtggagcagagaaagcaagaggaaacaacggtgagagttgaggctagtgaagaagaccaggcagagcctttaaaccatgttcagtgttgtctatgtcctacagtaataagaagccatgaaggtttttctgttttgtttttttggtggagggtggagggtggacttggggaggaagaaaggtaaggaagaggctagggagatgagggcaggaatgacttgatcagatttacatgagaaagaattacttcaggtgccatgtggagaaaagattggagggagaactaaagtggatgtgggtaaatgagtttcgaaagttattaaagtgattcaaatgagctgttgcaaaaactttgcatattatggtggtggcagatgtggagaaaagtggttagatttgagggatatttatgaggcaaaattgacagtagttgatgatggactagataggggagagaattgaggtataaagggtgagtcctagatttctgactatgcgtctgaaaggatggtgatagtgttcacttaaatagagaaaaagcaaaaaggaccacatttattgaggggaaatagcgagttgatttgggacgtattaagtgttgagttgccatcgaatccaatggcattgaatccaagagaccatcatagatactggtatgaagctcacagaagaggtccaagctgagatgtaaatttgagggttatttcgatctaggtagtgatctaagttgtgggagtagaagagttatcctcaggagtgaacagtggatgagaagaagaatgtgtaggtaggtccaagtcttgaggaacgctaacatgtatttaatgatggagtagaggtagatgaagctacataggaaactggaaagaaataatcaggaagtcgggaagagaaagtttcctagaaacagacagtgtgcacaataatgtcaattactgttggagaggtcaggtaagatgaggactaaaaatgttcgatgaatttaatcacatggaagacattgtgaactttagagctgtattagggaagtggcagtgctggaaaccagactgaaatggattgaagtgggtgagaaaacagttaattagtctaagaagttatgttgtgaatagaagaattcagtgagggttttgggtttctttggggaacttacagacatacgcagcaaatattggttaatacaagatagtttaatcacaaaatgagtcacgtgtcaatagagtccagaagaaaaaagcaatccctgaagtcttggggtagtaatagtggtggctaccatattgatcttactatgtacgaagcagtcttcaaagcatgtgtgtatatccttaaaacaactctgtgagatagaagatattattgttccattttatatataaagaaactggggcataaacaggttaatgaagttatccaaggtcctgcagctagtaaatgacagaaccaggatttggacctaggtggcctgatcagtctaagtttgtggtcttctccattcctcagtttttacctcagtgtctgcagtactacctctgtcacataatgttacatagtacccaggttggctgcgttaccatctggcatccatccatgacaaggacttctgggagatccaaagattaggaacactcaaatctataatctgaatgtgatttatgtctaaagaccagagttactaatcatttaacaataagcgagaaaacagcatgaattcaaaaagaagaaagtatgccaaaatagtttgctggagactgtaagtaagatgaataaggactttgacaaagtggactcaggggtaatatattttttaaacttttcaggtttagtaaattttacctgaaatttccttccaggttagaaaaaaaatcaattacttgaggatattatttactgaagatccgattaactgagatctattgtaatgatgttttaaaaactaggatttttgatatatttacttttctcaagatatttagtcactggataggaccttataagaaattcagttacctctttcaagtagtttatcaactattaccattttaatatcttctcagacttttccagtaaaaaagaaaaaaaagccttgacattttccatacttcattgaaataattaggaataaaagaacttgtgaggctatgtttcaaatttatatatttcaggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaaggtaacttgctgtttcatacatgaaggagccaaaaaactaaaactcacttccagctttaacatctaatatcaaattataactttggtgtgctgccaaacttagcctccatggcttaggaaagaacatttctctctttggcaaaatagtattgtatagtaacaaaagaaaataggccatttgtctgattgagtggtaaaagacccacaatcccatccaaattcatctactttgttagttttctgtctcaaaacatgaaaaacaaaggatgccattaaagaagcattatgtcacatttgtcactttgtgtcacatttagttggcattgttcttttcttcccatcctagaaaaagttgaaactctaccgagagtattgggatctttgaggtcaaataaatagcaatgcttttctccattcaagtcctgaaccaacctataaagcaaaagagttgccagatggagaagcaaaatactgcttttacactgataaaggacaaagtagagaatgaacttttcatctgtaagcagacgcttcctgatactgaacctcagaattagataggcttatctaccccatgatagacagtgctagactaccacataggggtcctgctcctctaagaattctgggatggtggaagggtgagaatactttctctttgcaggcaactgacttagaggagtacaagttgggccatgtatgcttttctttccaaaaacctgtttttttgttgttgttgttgtttttgggttttttttgtgacagagtctcgttctgtcacccaggctggagtgcagtggcacgatcttggcccactgcaacctccacctcctgggttaaagcaattctcccacctcagcctccaaagtagctgggattacaggtgcacaccaccacgcccagctaattttttgtatttttagtagagatggggtttcaccatgttggccaggctggtcacgaactcctgacctcaagtgatccacacacctcagcctcccaaagtgctaagatcaaaggcgtgagccaccacgcgtggcccaaaaacctgattttaaaatactctagtacttttgaggaatggggtctttgttttttaaacacaggctgtttttttttttcaagatggagtcccactctgttgcccaggctggagtatagtggcgcaatcttggctcactgcaacctctgtctcctgggttcaagcaagtctcctgtctcagcctcctgagtagctgggattacaggcacccgccaccatgcctagctaatttttgtacttttagtagagatggggtttcaccatgttggccaggctggtctcaaactcctgacctcaagtgatgcacccacttcggcctcccaaactgctgggattacagatgtgagcccctgcacctggcctaaaaataggctattttaggcctattttgattttgatttatgatagtagatattacttttatatctttttattaataatgtaattacatatataggattacatttttccattggttatgtaaaatagctgaatggatatgtcctaatataaaacacttttgtaagagtgataccatcaataatcaaagtaatgattcatactttatttaggtaatagttaaatgcctattttatctttaaatttcacgcctacccattcaacgagtaagtaaagtgcaggatatcaatatgctttcatctatcagcctacctattagggaggtcaagaaaatgttttttctgttttttaaatctttgagcacataacatactacacaaagaacaaattgtgaagactatgtgaatggtgaagaagtatattataattaaatgtagcatagagtaattgctgataaatagattgatatgcgtaggagaaaatgtactgtgccaaatttggcataaataataattgatgaaaatgaatttgttctttttttgtttgttttttgagattgagtcttgctctgtcacccagactagagtgtagtggcatgatctcagctcactgcaacctccgcctcccgggttcaagtaattctcctgcctcagcctcctgagtagctaggattacaggtgtgcgccaccacgcctggctaatttttgtatttttggtagagacagagtttcaccatgttggtcaggctggtctcaaactcctgaccttgtgattcgcccgccttgtcctcccaaagtgctgggattacaggcatgagccactatatttggtctcttatacaatcacagtaagattttctttttttctacaagatccataagaaaaataccagtaatactgttgtccccgatgctgggaacatgtacacacaatacacgcacacacttataccaacactactagctttccatgacctgggtttcctgtagattctgatacttccactcctatggttgtagttcaaggataaagaattttgagttcctctggcattctcactactgaactttcttagtcaacaaaggtgatattttgtatttcagattttcaggcatgagacaacaaaaacactaagagccaaggttgtacttccacactctgtatgaatgtgctgcaggttttgtagataacctatttaaaaacaattctacagctgaagagaagccacaatgggaagatactctcactgtcctcctttgggaggccaaggcgggtgaatcacaaggtcaggagtttgagaccagcctggccaacatggcgaaaccccatctctactaaaaatacaaaacattagctaggcatgatgatgggtgcctgtaatcccagctactcaggaggctgaggcaggagaatatcttgaacccgggaggtggagttgcagtgagccaagattgcaccactgcactccagcctgggcaacagtgcgtgactctgtctcaaaaaaaaaaaaaaaaagtatttgaaataaataaaaatagagacacaacataccaaaacttctgggatgtggcaaaagcagggttaagaggaaagtttataatgctaaatgcctacatcaaaaagatagaaatatctcaaattaacaacctaacattgcaaccaaaagtactagcaaaataagaacaaactaaacccaaagctagcagaagaaataattaaagtcagagcagaactgaatgaaattgagaccctcaaaaccatgcaaaggatcaatgaagcaaaaagttcattttttgaaaagataagattgatagaccactagctagattaacaaaaaaagacatccaaataagcacaatcaaaaatcacaaaagtgacatcacaattgatcccacagaaatacagaagatcctcagagaatattatgaacttctctaggtacacaaattagaaagtctagaggaaatggataaattcggaaacacaaattcccaagattgaactaggaagaaacagaaatcctgaacagatcaataacgagtaaggaaattgaatcagtagtaagaaacctatcaaccaaaaaaaaaaaaaaaaaaaaaaaaatgccccagaccaaatgggttcacagctgaattctaccagacatagaaagaacagctggtaccaatcctagtgaaagtattccaaaaattgaggaagaaggactcctccctgactcattctgtgaaactagtatgatcctgataaccaaaatctgacaaaaacacaaaaagaaaaagaaaactacagaccatggtccctgaacacagatgcaaaaatcctcaaaaaatactagcacactaaatccagcagcacatcaaaaagttaattcaccacagtcaagtgggttttattcctggtatgcaaggatggtccaacatatgcaaatcaataaatgtgattcaccacataaacagagttaaagacaaaaatcatatgatcatctcagtagatgcagaaaaagcatttaataaaatccaacatcacttcatgataaaaactctcaacaaactaggcattgaaggaacataactcaaaatagtaagagccatctatgacaaacccacagccaacatcatactgaatggacaaaaaaccggaagcattccctttgagaactggaacaagacaaggatgcccactgttatcactcatatttaacataatcaagcaagagaaagaaaaggcatccaaataggaaaaaaggaagtcgaattatgtctcttcgctgacaatgtaatttatacatgggaaaccctaaagattctgccaaaagactcctggacctaataaatgacttcagcaaagtctcagcatacaaaatcaatgcacaaaaatcagtagcatttctatacaccaataatcttcaagctgagaatcaaatcaagaacataatcccatttataatagccatacacactcacagtacctgggcatacatctaatgaaggaggtgaaagatctctacatggagaaggaaaccatagactacacaaatgaaaaagcattctatgatcatggataggaagattcaatatcattaaaatgtcatactacacaaagcaatctgcacattaccaatatcatttttttgcagaattagagaaaaactattctaaaatttatatagaacccaaaaagagcctgaatagccaaggcaatcctaaacaaaaagaataaaaccagaggcattacatctcctgacttcaaactatactacaaagttacagtaaccaaaacagcatggtactggtacaaaaatagacacatagaccaatggaacagaatggagacccctgaaattaagccagacacctagaaccacctgattgtccacaaaattggcaaaaataaacagtggggaaattgtttatccctattccataaatgatgctggaaaaactggctaaccatatgcagaaggatgaaaccatatgcagaaggtgcaagaaggatctagaattttaaagccagcaaatctgaaaactgtgtatctagtaaaaatagcctttaaaaattaaagcaaattaacaatgttttcagacaaaaaaagaaaaagctgagataccttctacaaaaagcattaaaggaaattcttcagttaaaaggaaacttattccagatagaagcatgaaatgcaggaagggatgaagcacacagaaagggtacatatgtgggtaaatatgaaagaatattgacaaagtcaaaattactatattatgtttttacacaaatataaaagtaaattatgttagaacagtagtacaaaaggcaagaggatttaaatagaattaaattgcttacaggttcttccatgctagaagtggtaaaaatatccatttaagttggagccagaaaaatctcataataagtcaaaaattcatttttatttttaaaatatagaaagttaaaatagtaaagtggaataatacaaatgccatttattaatacaaaagaaggcaagaaataaggggtatgggaacaaagaagggaaaagtcaaaagcaaatagcaatacaatcaacttaagcccagctagatcattgcattaagtgtaaatgaacaaaatattgtgattaaaattcaaagattgatttttcacacattaaaaagatattattttaaaaaatatgccaataatttacaacttacataaaatggataaattttttgaaaaatacaatttaccaaaagtaacccaagaagaaataaaaagtcaaaatagccctatatctataaaggaaattgaatttgtagaattgaaggtgtaattttaaacctcaccataaagaaatccagaatattcagattctgtgtaggatgcagaaggctagaaagattatgttgccaacataacaataagaaaaagccagataatctacaaaatcataaatgtttatgaatcctttagaaagctgagatcacaggttaaccaattagcctgacatctgaggagaaacaacttccacccagttgagacaggaggcaagcactgtttcacccaaagcagggcatggaatgaagactagctgttacacaagtgaataaaataattcattacatctttaattgctaaagacttgagtatgagctactgcgagagtatagaagctctgagaacttcagacactaaagggagagttcaaaaccactcatagactcttccctatggatgttcactgtgtgatcatgagaaagattgggagaaaggctggagaccacagaaagtttccttcatagtgcgggcatggagagaaaaatggttgtttttgcaaaagaaaaaaaaaagcaggaagctccatttgaatgcctctaacctacagagcaaaagcattaatccactgcaggaaaggcaccactctgacaaccccaaggaataggtgaagatgtattgcaacttgatgaaagacaaaggaaaaacaagaagaagaagcaaaataaaaccaaaccttgaacatgaagaaagaacaggaaactgtcttgggaccaacaattagagacctactacatcaagtgaaagggcaggtgctctgagagagccctgcttctgagacccaggggcacagggcctgcctaagattgaagctggactgggacaacagagaaaccaccacacacccgctttccatttctcaaacacaagatcctaagcttcaaatatacaaagcagcaagaatttatagtactaacataagaaatgtgaaaatatgcatttgtagttggagacttcaacactgtctctaagtaatctatagaacgtagacaggaaatgaatatggatataaagacctgaacgacactatcaacaatgttgtccaaattgacatttgtaaagcacttctgtcaacaataacagaatatacattcttttcaagtgcacttgaaagcttcatccagataaactatattcagagtcataaaaaaaaccttaacaaatataaaagacttgcagtcgtgcaatgtgtgtttttgatcataacagaattaaattagacatcaataatagaaaaaaatgtggaaaatctccaaatatttggaaattaaacagcaaaatcctaaataactaatggctttaagcaaaagtaacaaaagaaattagaaaatattttgaatttaatgaaaatgaaaatatagtacatcaaaatctgagagatgcatctaaagcaatgcttttcagaaaatttatagcatttaaggttcatattagaaaagaaagtcttaaatcaatagtctaaaccttcattgcatgaaactagaaaaataagagcaaattaaatccaaagcaaagcagaaggaaataaatgaggataacagcagcaatcaataaatttgaaaacagaaaaataatagagaaaaacaatgaaaccaaaaattggttctattaaaagataatgaagttaataaatgaaaagagagaagacaccaattacaaatatcaagaatgaaagagaatagaccttatagacgtttattttacattgtggcctcttcttttttctttttcttatttttgacaattttatcaggttgccattcattccatatttgcttcaagaaggaagacattaatatttagaaggtaatatcaacagtatttgaaaaccacttgaaaaggagagaaggaaatgagggagagaaagtcaattaaacagaaccttagcctgagatgccaaattcataatagaaactttgttgatgtgttattttctggggaatgtgagtctgagtgagataattaattggggcatgctaagttttcatttatctgagggacatccaaataaagatgtctagtaggtggataaatatgtgggttggtgtttgaagggaggtctgaagtagggattcaagtttgggagtcaccaccttacaggtagtattaaaaccatgggagtagattggtgatatgtagattgaaaaagctgaggccgaggatgatgtccccttactttctaaaagtagtttccaattcctcggtaccacaagacaccacagggagcagtcccaagtaccaggaaaaagaactagcataagcaactcaagacttttgtcctcaaagaagaacctagaacagctcactatattaaaatggggttggagctgtgtatacaaatagtgggcaagtgcatgcaggcacttcttggacttaaacctgttcagaagagaataaactttctaaccagattttagtggctagacataaaaagtgagctgaggaaacatctaacaagggcgatagtggagctgccacataaccaaactgtattgttagacatggacagcattgttttcttgtttttccataagtatcataaaacactaaaaacagatgataatgattatgatgttttaaagatactgctagaatgttatcaaatattccataacagataataaatattccaggcatatgagcataggcatatttatagggagaaaatcaattttctgcaattatgtagaacttacattcatactattgtatgctatcacatccatctctcagtgtccaaattcttgcttccattttgaaaaccaaagctggtttggtgagggagaaatattctcttctgtttactctcttataatgaaaatcttttttctcttgtgtggtagcaagaattctccctatatgattgtgtggaactataaaccttcaataacatctatgattccttttagctagtgaaaaatagtgttatacttttatactgtagtttgcaaagaagagagattccctcatggtacctcaagaaaaaaaaaagactctggtaaagcttcatgtgaactgaaaatggaaagctatcaggtgcccagggagcttgaaggaagagcttttcccttcatctctgcaataagctacatgatttctctcacagcatcttcacttcccttcactcatctgctctgattgccactttactaactggccacctctgcctagttatcatttctgtttctttacaggtctattttgaatgtaacttcagctttccatagctcttagctttacctcctggcatccttttcaattctcccatttctatctcactcattattttcaattttaggtttacaagaataacaatgcttgatctagctcatcttttctgtcagtttgtcttaaaggtctctgctggcctaaaggtcacctattcttgagtcaggtacacgctctcatccagacatcagtaacttaatcatttagtccaatacttggccattttggcagaaatggatacgcattttttctcttcaaagaagatatccacataataagttttcaaagtttgacctttcctgtaaatattgcatagactttagtccagattttagtacattatcctgtgtaataaatttctatcttttataaattaacttttggtatttagaaatacatattttggggtgaagtcaattctatggtatttcctagcttactatcttcctcatggagaaatagaaaacacaaataatccttagttgaaatataaacatttcagttttagtgaagtgtactatcaccaacttgtaatggtgttacaagtcatcattctgcatacaccagagtgacccaaaatgctccacagtctaggtaaactgcaggagtaagcttaaggttatttaacttccaaaccccagatctctgctctgatggtcacttgaaattctacaatttcaaacacctctgaagacattcagttaaggcctctggcctctagatggccctctatcttttgggaatgccttaaagtccatttcatgagggaaagttgaagccagtgatctttctgggatagcacaagttaccctgtatctttgctcaaggaattctttctgtaggcttcctagagtataccagaattaaatttttctcccctttgatgagtctctccaaagcaaggagtaatacctgtattacttttgcccacccatgaagggcacttgattttatttcaagccctggcttttagacgtaccttagcattttgtgagttgtaattaaaatcccaacctcttcctaggaatacaaccataatctcctaaactctgtcctcacctccaacacagtccttttggctttcaagaactatccacaatcaggctcagatgtgcttttcctttgttatgtaatcagatgaatctgaaagtggaaagttacatgtattaaagtgaggagatgggtagaggaaggtggaaatgaagaaaaagaacgaatctgaaaggaatcagagaaactgtattctgatactattgtttagatttctaaaggaaatggaaagatgtttggcaatgagagaagtcagttatgatttttagaagatggttgttttcttcagcatttaaaaatgtttttgctttgttttaattttcaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttcaagaaatcatttctttacctaattttttttaagagagcattttaataaagtcctgtctaggttaacctatacataagtagatgttcttactttttaaatacaaaacaatgtaatcagaattaaaaagaagggaatactacagcactctgtcatcccgtcccatattccaatgctggatattcaaatcactctgtaatttaataggggtggtctcctccctggacaaaggtcacccttaataagacatctactagagtttccagaggcaatttgccatgggataaggattgaagatgaataatggcgtttccccataatctaacactcagtataacaggtgtgaaaatagagattgaaacagagaacaatgtaagacattcagcctaggagttcaggaaagtctgccttagggagaggatggacaggtgagctgaatcttggaagataagtaggaaattgccagatcaagaaaaatgggaaggtgggaacagcataaaaataggtacagagggaccctctatctctgtgaaagagttaaagggacttccaagctacgttggtggaaagctagcaatccctgagtcattctcctgttaggcctccttgaaatactatgtggaaacacacacaaaaaacattttaacagggctggaaactagtaatattactta

SEQ ID NO: 561 - DNA, 55065 bp, Homo sapiens
ttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaatgcggaattcggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgtttttta

SEQ ID NO: 562 - DNA, 55505 bp, Homo sapiens
tattacatgtcaagcatcaggagaacaggaacaatactgaacttgaagttcagagaattgagttcaaatcccggctaacacgggagtttggagaaatcgtagttctgtcacttgttactcaagtgtcataattatttaacctcttagaacttcagcttccacatctataaatggaaacggcatcactttttcgcaagttggggatgattaagtaaaaactgtatacctgaaaacatctgacacaacacttgacacgtagtttgcactcactgactctgactctatgtttatcaaaatggttaagataaaaattgaatgattttagacccataacatttaaatgagctctgaattagtagttatttattctctatcttcttgtttcaaaataggctcccaccccaaattaagtcaggaaaatatgttgtaactaaacgcaacctgtaatttcagtgtcgagatgaatctatcttggtttctcacttcttgttctagctggagagtattctggtagttttcagcttcagaaactggagcccctagaccaaaatcatattctttggtggtaacctagtacaaagaatgggaaataatacagaggcattcagtttaaaacagctctgtgatttcttacatcaatacattttgaaaattgataatattcttagattttttttaaccatttcccaccagctaagaggatttcatcaaactttaccttcttaaaatttataaaactttttctgtgtgttgtccaaatggtactgaacatgcttttcaaagacattccctacactatccttttggtaatcatggttctacagaaatatggatcagtagcaaattaaagagtctacctctaggcttgtgttgtccaaaatagctattagtgagttacgtttgctgttgctactctatacaagaaaaaaggtttgcaattaatatcacaaagagtgaatttcctgaatatagaaataatccctagaaataaaaaagattaaaaaagtactctaatagaaaaattggcaaagaatgtgaacatttacagaaacggctcctaaatattaagatgttcaatctcaacctttagtgacacaaattaaaacactgagatacccccttttaaccatcacatggcaaagatcagtaacatggatatagcgtccttacgtatcaccggtgggagagtaaactgatacaatatttatggagaacaatggtataaaatctatcaacatgacaaatgcacatagcttctgttcaaataatttcatttctagaaatttatactacagctatatatatgtacacttatgcaaaataacaaatgttagagatttttcactttagcatactatacatactattctgcatcacgctattttacttgacaacatatcttagagactgtgtaacttaggaaaacaattttttctttccttgaatcaaggctaccattgtgttaaaaaagaatttgttatgagcatcttagatctttcctcaaaacacagctgctgttctccaaaatcctacctagggaattacagaatcaggatctccccagtcactgaccttatgatgcactctgtgtaacccagcacttagacaggccggcagatttatttcccttttttctcttctctaaacaagacacaactcttcttcattgcaacagttactgccccacctggaacctcaacattagatctcacagaatatttcaaattatgaagcatttaaacccccaggggctggactgaactcctaactaccatttcttacatggtttctgttaaaaatgtattgctagttataaacatgatttagaataacagaatgaaacgactcctcactagagcagtactgttcaatttttactgaatttaagaatcatctgggaatgttgtgtgaatgcagattcttatttacaggctgagatttgacatttctataaagctgcttggagatccctatttggttggtacagagaccacatgttgaatcatgctgtgctgtaatttctgatttatttgaatagcaaggatctatttaagtctaaacccatccaatattcagagtacttctgtaattttgtcccttcctacttctccaaatttacctcctacttgatacctccaagaatccctctatgaaagacaaactatgcaacacttaagggtctcaccctgtcacccaggttggcatgatcacggctcactgcagcctcgaaccccaggcccaagcaatcttctcaccctagcctcccaaatagctgggaacacaggcatgtgccaccacaattggctaattgttttaaattttgtagagtcagggtctccctatgctgccctggctggtctttaactcctgggctcaagagatcctcccgcctaggtctccctgggattacaggcatgagccactgcacccagccaacacattcttaatacatatattcaaaagtattttatcatctgttcaatgagccttgccctcactattttctccatttaacttaagacatttttaaggctcagctggaattccatattctccaggttttctctgtcttctccactgcataatgatcatctcttaattgatatttatatatatagaagaatttatgttctaaatttttctggatgtcttcctcacacatttattagactcttaagaacaagcaatgtccaaaaactctctctatccccattaacctgcacagttatttacgtaataaaaagtgtcaaaaaatttgttgaggttgataatgaagcagtgtgataaagcatacaaaattaaactttcttcctcctctttggtaaaccgaataaagtggggcttttgcaaaattacctatcaggcccagctaggaattaaaaatagcaagagaccacaagtccacctgacaatcctaaccaatcatgctggagttgctatcctccctccaccagctttgggggcaatatcactagaggaaagacacatcagtgtatctgaaattcccatgcctggtctgccagcttccctacctcaggccacataaatatcctcaaccttgctgcaatctcatcattagaatggaacttgtgctcctgtaccgttctcagagaaggcaagtgaaacaatgttccttcttaaaaaaaattattttttcttttttatgctatccctcccctaggcccccaactccctgacaggccctggtatatgatgttcccctccctgtgtccatgagttctcactgtttaactcccacttatgagtaagaacatgctgtgtttggttttctgttcttgtgttagtttgctgagaatgatggtttccagcttcatccatgtccctgcaaaggacatgaactcatccttcttaatggctgcacagtatccatggtgtatatgtgccacattttctttatctagtctatcattggtgggcatttaggttggttccaagtctttactattatgaacagtgctgcaataaacatacatgtgaatatgtctttagagtgacttataatcctttgggtatatacccagtaatgggattgctgtgtcaaatggtatttctgattctagatccctgaggaatcgccacactgtcttccacaaattagttgaatttacactcccaccaacagtgtaaaagcgttcctatttctccacaacttctccagcatctgctgtttcccgactttttaatgatcgccattcaaactggtatgagatggtatctcattgtggttttgatttgcatttctctaatgaccaatgatgagctttttttcatgtttgttcgctgcataaatgtcttcttttgagaagtgtctgttcatatcctttgcccactttttgatggggtcgtctgtttttttcttgtaaatttgtttaagttccttatagattctagatattaaccttttgtcagatgggtagattgcaaatattttctcccattctgtgtttcctgttcactctgatgatagtttcttttgctgtacagaagctctttagtttaattagatccatttgtcaattttggcttttcttgccattgcttttggtgttttagtcatgaagtctttgcccatgcctatgtcctaaatggtattgcctaggttttcttctagagttgttatggtcttatgttttatgtttaagtctttaatacatcttgagttaatttttgtataaggtgtaaggaaggggtctagtttcagttttctgcatatggctagccagttttcccaacatcatttatgaagtagagaatcctttccccattgcttgtttttgtcaggtttgtcaaagatcagatggttgtagatgtgtggcgttgtttctgaggcctctgttctgttccattggtatatatatattggtatatatctgttttggtaccagtaccatgctgttttgattactgtagccttgtagtatagtttgaagtcaggtagcatgatccctccagcttcgttctttttgcttaggattgtcttggctatatggggtcttttttggttccatgtgaaatttaaggaagttttttctaattttgtgaagaaagtagatggggacagcattgaatctataaaatactgtgggcagtatggccattttcacaatattgattcttctgatccatgagcatggaatgtttttccatttgtttgtgtcctctcttatttctttgagcagtggtttgtagttctccttgaagaggtccttcccatcacttgtaagttgtattcctaggtatgttattatttttgtagcaattgtgaatgggaggtcactcatgatttggctgtttgtctattactggtgtataggaatgcttctgatttctgcacattgattttgcatcctgagactttgctgaagttgcttatcagcttaaggagattttgggctaagacagtggggttttctaaatatacaatcatgtcatctgcaaacagagacaatttgactcctctcttcctatttgaataccccttatttctttctcttgcctgattgccctggccagaacttccaatactatattgaataggagtggtgagagagggcatccttgtcttgtgctggttttcaaagggaatgcttccaggttttgtccattcagtatgatattggctacaggtttctcataaatagctcttattattttgagatacattccatcgatacctagtttactgagagtttttagcatgaaggggtgttgaattttatcgaaggccttttctccatctattgagataatcatgtggtttttgtcattggttctgtttatgagatggattatgtttattgatttgcgtatgttgaaccatacaacttcatcccagggatgaagccgacttgatcatggtgaataagctttctgatgtgctgctggatttggtttgccagtattttattgaggattttcacatcgatgttcatcagaaatattggcctgaaattttttgctgttgttgtttccctgccaggttttggtatcaggatgatgctggactcataaaatgagttagggaggattccctcttttttctattgtttggaatagtttcagaaggaatggtaccagctcctctttgtacctctggtagaattcagctatgaatccatctaatcctgggctttttttttggttggtaggctattaattactgcctcaatttcagaacttgttattggtctattcaggaattcaacttcttcctggtttagtcctggaagggtatatacccttccaggaatttgtccatttcttctagattttctagtttatttgtgtagagacgtttatagtattctctgatggtagtttgtatttctgtgggatcagtggtaatatctcctttatcattttttattgtgtctatttgattcttattagtctggctagcggtctattttgtttatctattcaaaaaaccagctcctggattcattgattttttgaagggcttttcgtgtctctatctccttcagttctgctctgatcttagttacttcttatcttctgctagcttttgaatttgtttgctcttgcttctctagttcttttaatcatgatgttagggtgttgattttagatctttcctgctgtctcctgtgggcattcagtgctataaatttccctctacacactgctttagctgtgtcccagagattctggtatgttgtgtctttgttctcattggtttcaaagaacttaattctgccttaatttcgttatgtacccattatcattcaggagcagtttctatacagttgcgtgattttgagtgagtttcttaatcctgagttctaatttgattgcactgtggtctgcgagactgttatcatttccattcttttgcatttgctggggagtgttttacttcaattatgcggtcaattttagaataagtgtgatgtgttgctgagaagaatgtatattctgttgagttggggaagagagttctgtagatgtctgttaggtccggttggtccagtgctaagttcaagtcctgaatatccttgttaattttctgtctagttgatctaatattgccagtggggtgttaaagtctcccactattattctgtaggagtctaagtctctttgtaggtctctaagaacttgctttatgaatgagggtgccctgtattgggtgcatatatatttaggataattagctcttcttgttgcattgatcccttaaccattatgtaatgcccttctttgtcttgttttgatctttgttggtttaaagtctgttttatcagagactagaactgcaacccctgcttttttttgctttccatttgcttggtaaatactcctccatccctttattttgagcctatgtgtgtctttgcatatgagatgggtctcctgaatacaacacaacaatgggtcttgactctttatccaatttgccagtctgtgtcttttagttggggcatttagcccatttacatttaaggttaatattgttatgtttgaatttgatcctgtcattatgatgccagctggttattttgcccattagttgatgcagtttcttcatagtgttgatggtctttacaatttggtatgtttttgcagtggctggtatgtttttcatttccatgtttagtgcttccttcaggagctcttgtaagccaggtctggtggtgacaaaatatctcagcatttgcttatctgtaaaagattttatttctcctttgtttatgaagcttagtttggctggatatgaaattctgggttgaaaattcttttctttaagaatgttgaatactgacccccactctcttctggcttgtagggtttctgcagagagacccaatgttagtctgataggcttccctttgtgggtaacccaacctttctctctgtctgcccttaacattttctctttcatttcagccttggtgaatctgacgattatgtgtcttggggttgctcttctcgaggagtatctttgtggtgttctctgtatttcctgaattggaatgttggcctgccttgcttggttggggaagtcctcctggataatatcctgaggatatttccaacttggttccattctcgtcactttcagagtataccaatcaaaggtaggtctggtcttttcacatagtcccatatttcttggaggctttgtttgtttcttctcatccttttttctctaatcttgtcttcatgctttatttcattaagttgatcttcaatctcatagcctttcttccacttgattgattcagctattgatacttgtgtatgcttcaccaagttctcacgctgtgtttttcagctccaacaggtcatttatgttcttctctaaactggttattctagttagcaattcctctaacctttttaaaggttcttagcttccttgcattgggttagaacatgctcctatagctcagaggagcttgttattacccaccttctgaagcctacttctgtcaatttgtcaaactcattctctgtccagttttgctcctttgctggcgagcagttgtaatcctttagaggagaagaggcgttctggtttttgaaattttcagcctttttgtgctggtttttcctcatcttcatggatttatctgcctttggtgtttgatgttggtgacctgcagatggggtttctggggtttctgtgtggacgtcatttttgttgatattgatgctattccttttgttagttttccttctaacagtcaggcccctctgctgcaggtctgctggagtttgctggaggtccactccagaccctgtttgcctgagtatcaccagcaaacagcagaagctgcagaacagcaaagattgctgcctgtttcttcctctgaaagcttcgtcccagaggggcacccaccagatgccagccagggctctcctatatgagatgtctgttgactcctgctgggagatgtctcccagtcaggaggcatgggggtcagggacccacttgaggcagcagtctgtcccttagcagagcttgggcactctgctgctctcttcggagccagcaggcaggaacattcaagtctgctgaagctgcacccacagccaccccttcccccaggtgctctgtcccagggagataggagttttatctataagcccctgactggggctgctgcctttctttcagagatgccctgcccagagaggaggaatctagagaggcagtctggctacagcagcttagccaagctgtggtgagctccacccagttcgaacttcccaccagctttgtttacactcatttggaaatgcagaaatcacctgccttctgcattcatctcactgggagctgcagacagaatagaacagttcctatttggccatcttgccagccactaaaaaattatttttaatttattctttatttttttcaatgtgaagtctaaaataaggaagaacttttattctcaattaggaagtcacacagcagagtggttaatatcatgtattttggtatcagcctgcctacattcattatcctagttctgccacatcttagctgtgtgatcttgggcgacctggttacttctctgactatagcttcctcatttataaaacagggatgataataagagtatctgcattggctgggtgcagtggctcatgcccataatcccagcactttgggaggctgaggcgggcggatcacctgaggtcaggagtttgagacccacctggccaacatggtgaaaacccatctctactaaaaatacacaaattagctgggtgtggtggcaggcacctataatcccagctactcgagaggctgaggcaggagaatcacttgaacctgagaggtggaggttgcagtgagccaagattgcaccattgcactccagcctgggggacaagagcgagacttcgtaccaaaaaaaaaaaagggtctgcatcatagagttgcgtgaggagtaaatgaattaatatatgttttaactttagcacttagaatagtgcctggcacatgataagcactatatatattatttactattattactaattcctctcactgagtcaacttatttaattggctatcaagtcctactgctcttttcactaaaaattatctcagttacatttcttccatccctactatcactgttttagttcatgctttcagactgtagcagtcacatgtattcactttatatgtaaacttataaatagctagaataagaatgaaccagaaatatgtttctggggataaaaagatgtaaaacaaatagaatcttacaatttcaaccctaaatgaatctaggaaagtccagaacaaataaatcagaaattacaccacagcatgattactgctacatcagagtaatgcacacagatgctaaggtaacactgagaaagaagctacaaaaaaagtatttctgccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaaaaaaaaaaaaaaaaagtatttctgacttctacttcttcaaaaaagacttaggatctactcttcattccaaaagaactatgaacatatcccttctggagcacttaatgcattatattacttttatgggatgtccacagccatggctactttaacgtgtctaaaacagacttcctttttttttttttttttgagacagtcgtgctctgtcacccaggctggagtgcagtggtatgatctcggctcactggaacctccacctcccaggttcaagcaattccctgcctcagcctcccaagtagctgggattacaggcacctgccaccatgcccagctaactttgtatttttagtagagatggggtttcaccatcttggccaggctggtgttaaactcctgacctcatgatccacccgcctcagcctcccaaactgttgggattacaggcgtgagccactgcacccggccaagactctgcctcttaatgtgatcaccttaggggttagaatttcaacctaaaaattttgtgaggacacagaaattcggactgaagccacacattagaggaacagaaagaaaaagctattgggcgaacaaagaagggagtactagatcttgtaagtgaagacaagggccaaatcatgtaaggccttacaaagtttggattttatttttaattgcagtgggaagccattggtgtatttttgagccaggatcatcttattataattttctttttcatttttttttccctctcccttctcccctcccacaggatctcattattttgaagtgattgatatgatatcagtgtggagaataggttgtagggagcaacagtggaagcggaaagatagcagggaatggttgcagtattttaggtgggagatgatggtgacttggaccagggaggtggtaacaaaaatatagagaagtggatggatttaggatatatatttgaaccaacaacatttgctaataaattagaagggatttattgcagtgagccgagatcgtgtcactgcactccagcctgggcaacagagtgagactccatgtcaaaaaaaaaaaaaaaaaggcacagccatgatgagttgcctgtatataataggccccagagagctcccttgccccttctaacatatgaggacagagtctgaaggtaccatctatgaaccaaaaaacctcagacattgattctgctggcaacttggatcttagaattcccagtctccagaactgtaagaattaaatttctgttgcttatatgttatttcattatagcagcctgaatggactaagatatttgccagtaacatttgacttcaggtcctctgctcttgcttttcctctctcaggaacactttctacccagcctttcacatggctatcttctcaccctcagctctttggctgaaatgtcagagggtcttccctgacttcttacctaaagtagcctctctcctagtcactctctcaaataagtgataagctatttgcacttatcactacttgaaattatatcatttgctgacttgtttactatctccccatactagaatataaaattcaagagctctaggcttttgtcttgtctctgttttatccctaatgccttaaaagtgcccagcacaaaggtgaaacgcaataaaacattttcaaaataagaaaatttaatgattcgaacaaagcagtttcaatggtgggtgaaaacaagtctgaaggggactaatgaatgaatagtaaagaaaaagaaatggaaaatgtaaacttcttttaggaagcatgattgtgagaggaagagaggtacaacaaaggtggaagacaaccaaggttgtggaaacgtcattatgggaagagaaaaacttgttccttaattctctttacataaggatcctctttcagaattaaaagtcctgcatcctctcctcagaaaaatgcaaatacacctttacaaacaatttcaggggatttaagactctataaggtccttggactccaggtgaagaagccctacagtacagaaacaatgaagattcctaaggcatgagttaatgttaattgatggagaaagacagctgaggtaataagaggaaacccagataaagatgtattgccccgacacaagaaagacaaaagcaaggacaggtgaagatttagacacttgtaatcccaataatcccaacactttgggaggccaaggccagaggatcacttgagcccaggaatttgagaccagcctggacaacatagtgagttcctgtatctacaaaaattaaaaaataaattagccaggcatagtggcatccacctgtggtcccagctacttgggaggctgagataggagaatcacttgagcccgggaggtcaaggctgcaatgagtcatgatcgcaccactgcactccagcctgagcgacagtgagatcatgtctcaaaaaaaaaaggtaagtgtcatggaaatctgaggaagtttctgtctggttgaattttaatttttcagtgaaacaggagctaagattatataataaaaagtatcatcggtgttgagcaaaatatgaagcacataatatgtattcaacaaattattgattttttgatagaatggaaaatactggagtacttcaatggaattctgaaatctggttccacaaaagcttactacagttgaggtgggtttttctttttaaaaatattgtctccaaaagtgtagacttatagacattgaagtagaaaggaactgcctcactaacagaaggatgtggaaaaccatacaagatttatgaataattctgagagagtattttatataataaaaataagtggataaatattttgggaaacaatcagcaaactaaatactgcgagcaacaataaagattaatcttaaaaaaaatgttgagtaaagaagcaagatgtaaatgaatacttagtacaattccattcgaagttcaaaaacaagccaaactgtaatgtgcatgttcacatacaatgatgtgaaacattaaggaaaatcaaggaagtggctatcttagaagtcaggagagtggctatctctggggagggaaagaaatatgtaatctgaaaaggtgataaatagtaatacctctaactgcctctgtgtatggaggacttcaaaaccaaatcgtcctaaacaaactagtctaagcaactcaaaaagaagacagaaaagatctcccagagaatctctacacctgattatattctgggctacaggcagtgatttttcttcagaaggtaaacagtacgcgagatattgtggaagctgccattaaataatgccaaagtttaggatttaaaattaatatttaattaatgtaccgtcctagttatttcccactaattaagactgaagagtttggctcattaatcaattaaaatacaaacaagaatctgtcttatcctggaagcagattcgaatgcgacatcctacttctataactaacctgtttttttctacttacaaacctattgttattctacttatgtccttacacgtaaacaaagtatacttgaaatgctgaacaccagtacagaaaattttaaacaaggaaatctcctaggatataaggtcctggaatggaagaaggaaaacgttgggacactataatctatgcaaactttcccgaagctgcgaaaaaaaaaaagtgaaaaaaaaccatatttctgtgagtttttaggtatcaagtccatgatcacctagttatccaatttaagtctcaaatagtttttcaacaaaagccagctttccctgcctttactgtgtataatttttactaaaattatctgagattttcatgcaaatgcctatgtaatctcagcctttcaccaccccaagtctagaaagaggctcagaaatgagcgatcgggagtcaggctgaactcccaaatctgtgacttccaaattcctcggctccaccagagcttccagagcgtttctaaactgaacagtctccccaacaaccaagcggagagctgcgggaggacgcgaagcagtgaccataggaactgggctcaaacctaacctcccaagaaacaggggcaactcgtgctgccgagcttccggccggcagctgtgcccgccgctgcccctcacagccgctcccgctgctagcgcccaactccgcccgccacggccccgcacccgccactcctgcccgcttgcagccgccttctcagagaccttccagtccagtagcagcactctccccaccccgcgcacctccgcagcttctacctggagctccgggtccctccccgggctcctcggcccgccgtcctgcccagagctcatccccgcgactgtcagctctcggcctcagcgggggatacaagaaccgcccactctccatcctccgcccctttctcctcccttcccacccccaaatcgtcctggccccgccccggcggatcggaggaaggacggagcccgcgggaaggaggagggggcggttagcgccagccagtgccgccgtggccccgccctcacgctctgtaccggagtggggctcgtcttccacctccccggcgccccagctttgcttccgtcccgctcgcccccaggcccggtgcgcacgcgtacctggctcgaccttccttctcgcggggtctacaagccgtgcgcgcgctcctacgcacggagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccggtgagcgtgggcagcctggagtcaggggagcctggggaccacggccttggtcagctctgcacgatcagggctgaatcaggaagtggcagatctagcaacaaagtccagattcctgaccgatattccttctccacatgccagtccttttccaaatcccctcaccttaaagtgacaaatgagctttttagtgaaaaagaatgagcgctgcattcttctaccaattttttggagcccagaatgggggggaaaaaagtcttcttaatttttcttaatacctaccatgtcccttcttaaataactcaagagcttctggatgataatggtgactttatctccttttcctgcagatgacatagacactaggtttttacagcaattctctgatgaccttgatatggtagaacgctgtgtatttcaagagtaagctctcgtttgaggagactaacaattcctgttttcgccaggtgagtactcatttttccccccacaagatatcattggcagggataaacaacttttgtgtagaacaaatttagtcataaaaatacatttaatataaatgccatgtttttccaatgtcttttcatcgtgttattacatggtctcatattttgtcgcatttattttcagatatcatatactttgtaagtataattagataccaaaaaaaattaagtgtccctgttattttagattaagaggttagaggacacaaggagcacatatcctcggaaatgtaattttttaaatgcacaaaataacaaactgagaagttatgttagagggaataatgtataatctcatttcctcttcagatactaagattattttgaatacattatctagcattattaaaaacaaataggaaagaatgttctaagtttaaaactatcagctggagttgaagacttcgggggtggggagattattaatataggaagtaggaaagtacttcccttatagaaagaataagaaaagtttaagcacttatgtatgccacctagacggtactgaagattatttggaaagaatataaggaaatgatcattttaaggccaaaagagggtgaaaagattttccttttttttcctatcaagaactgttgactttctcccctaacctgagaaagtaaaaatttccttccctctgtggaaacccaaggggtagtgagtgtcccaccctgccccaactaaaccttttttttttttttttttttttttttgagacagagtctcactctgtcgcccaggctggagtgcagtggcacgatctcggctcactgcaacctccgcctcccgggttcatgccattctcctgcctcagcctcccaagtagctaggactacaggcgcccactactacgcccagctttttttttgtttgttttttgttttttgtatttttagtagagacagggtttcactgtgttagccaggatggtcttgatctcctgacctcatgatccacccgcctcagcctcccaaagtgctgggattacaggtgtgagccactgcgcccagactttttttttttttccttttttttaagacagagtctcactctgttgccctgtacccaggctggagtgcgttggcatgatctcagctcactgcaccctccacctttcaggttgaagcagttctcctgccttagccccttgagtagctgggaccacaggtatgtgccaccatgcccagctaatttttgtatgtttttgtagagatgcggtttcaccatgttgcccaggctggtcttgaactcctggactcaagtgatccacccacctcagcatcccaagtgctgggattatatgcatgagccactgtgcctggcccaggctaagccttatatagtaccctgtgcttgctctctcgtgacagacaccttctaaggtcttggttttctagtcccttaatttttccatcatttcaaaagcttcactacaaaaacctctgttattactattttttgttttgttttcactgtcctcttcctgatcccctcaaaaaaaaatctgggactccaattccatatgtgttaagccacttgatcttgttccacagctcactgatgctgtgttccttttttttgtttgtttttttgagatggagtctcgctttgtctcccaggctggagtgcagtggcgcgatctccgctcactggaagctctgcctcgcggcttcacgccattctcctgcctcagcctcccgagcagctgggactacaggcgcccaccaccacgcccggctaatttttttgtatttttagtagagacggggtttcactgtgttagccaggatgatctcgatctcctgacctcatgacctgcccgcctcggcctcccaaagtgctgggattacaggcatgagccaccgcgcccggcctgtgttccgttttttaaatcagagagtttcctccttatgccgaggcctgaaagttccaggcaatgtccattcatagggctcactttatttcctgtttctcaaggatcactctcccgaactgcctgttgtccaatatctaaaagccattgcttcatgtgttttgtgttttgatgctgaaagcaggcggggcacggtggctcatgcctgtaatccagctactcgggaggctgaggcaggagacttgcttgaacccgggaggcagaggttgcggtaagccgagatcgtgccatcgccctccagcctgggggacaagaacaaaactctgtctcaaaaaaaaaaaaaaaaaaaaaagatgctgaaagcatgaggataagtctggtctctgttactccatcatgactagcagcagaagtctgccattcttcacagttccaggccccatgtcactaactatcctcaagggatgtggtttgcaatgcaaaaattgcttcaggctgggggaactgtaagtgcaaaggtcctgaagcaggagaaggtttggcatagaatatgcttgaggaacagcaatggggtgataggtctggggtcgaataaggcaaagagacaggagagagtgcttgctagtagagttgtttgctacggctgtgcaacaatttaccacacacttggtgtctttaagcaacacaaatttattatcacacggttctggagatttacaagttcaaattgggtctcactgggctaaaatcaagatgtcaggcaggtctacattccttctggaggctctaggggaaaatcccctttcttgcctttccagcttctactggcagcccatgttccttggcttgtgatcccagtctatattcaacgccaaaaatggccagtcaagtcctcctcacattgcatcatggctaacacattctacctccctctttcacttctaaagactcttgtgtggcaggtgcggtgactcacacctataatcccagcattttgggaggccaaggcaggtggatcacttgaggtcaggagttcaagaccagcctgttcaacatggcaaaaccctgtctctccccaaaaatacaaaaattaactgatcgtggtggcaggcacctgtaatcccagctacttgggagctgaggcacgagaatcacttgaacccaggaggcggaggctgcagtcaccctagatcacaccactgcactccaacctgggcaacagagtgagactctgtcccaaaaagaaaaaaaaaaaagacccttgtgattacattagtaccacccaattaatccaggagaattttcccaccctcagagtcagctgattagcaaccttaattcccccttgccacataacataacatagtcccagcttctggggattaggacaaagacatctttgaagactattattctgcctaccacagctggggaccagatatgtagataatttttttctctgatatgggaagcaactagagtgtgttgagcagaggactgctgtgatctgggttttgttataaaaggttcaaaccagtccaggcatggtggcttacgccagtaatcccagcactttgggaagtgggaggattgcttgagtacaggcattcgagaccagcctgggcaacacagtgacaccctgtctctacaaaaaaaatgaattttaaaaattagccagatgtggccaggtacggtggctcatgctgtaatccaagcactttaggaggccaaggagggcagatcacttgaggtcaggaattcgagaccagcctggccaacatggcgaaacatcgtctctactaaaaatacaaaaattagccgggcatggtggcaggtgcctgtaatcccagctactcgggaggcctcagcaggagaatcatgtgaacccagaaaggcggaggttgcaatttctttgcaacttgaatttctctgattcctagttaattatctgtttgggattcctcaatctgtgaattatgtttttatatcctttgcccatttttctattgggttttctttttccttgctaatttctaggtgttctctttttattccagccattaaataccatcagctttggacacagaaaatatctccttccagtctcttatctatctttttgtttatatttttttcattgaatagaaattctcaattatgagtaatcaaactcactgttttcctcccttattgtttaagctttttagtcttgttcaagaaatctttcttcactccaaggtaacagatattttcttctattgcatttacagttctgccattcacatttaggtctttaatgcatttgcactccacttttttttctttttgagacggagtcttgctctgtcgcccaggctggagtgcaatggtatgatctcagctcactgcaacctccaccccctgggttcaagcgattctcctgcctcagcctcctgagtagctggaattacaggcacccgccaccacacctggctaatttttgtatttttagtagagacagagtttcaccatgttgatcaggctggtctcgaactcctgacctcgtgatccgcccacctcagcctcccaaagggctaggattacaggcgtgagccaccgcgcccagcctacttctgtgtttaagatcctgcttatgtccacatagttagccaatgttcacgataccatcatactaaacttagtctgttctatctcctttgtcttatagtgccacctgtgatatatgtgaagttcctgaaatacctaagtccaagttacagctctgtcatattctactgattatttgttcctgtacctgtacaaggttatttttattactttcactttgtggcatatctttttgttttttttaatttttttctgatagggatgaggtctccctatgttgcccaggctggtctcaaactgctggactcaagagatctttccaccttggcctcccaaagtgctggaattacaggcgtgagccattgtgcccagccgcgtagcctatcttaatatctagtaaagaaagccactttgttctttttctccagattgatttatctctttatgtacctttattcttacatatatattccagatttcttcttgaatggcaacctaaatgccagtccaaagaggcccccaatagacttgttcacccttcatgtcctcaactctggggaagttaaggtaagactcacagggccaagtctaccctattatacttggttcctcctcagtccttttattagattgaagtttaatgtgcaaattgataattatatgttaccattcttttacgtttgttgatttcaaatgccatgttttagagttttgtgttttttaaaacgttttttcaattttgtattttgaaaaagttttaaacctacagaaatgtaataataataatatgtagaacaactttttaagctttacctcctagatttaacagttgttagcattttgcatattttactgtctttctgtatctatgtatctatctatctattgctaaacaatttgagggcaagttgcagatacaattcttcacccctaactatttcagtatgtatttcctaagaacaaggacattgacttatataaccacaatacaattatcatattcatggcatttatcacattgatccaatattattatctaatattgtcccatatccaaatgtttcagttatctaagtaatgatctttgtagtacattccatccccttcccaattcaagagcattggttgcatctgaaataatgtatctttagcctcctttaatctgaaacagttcctcagcctctctgtgtctttcataacattgacatttttaggtagaagctatttgtttcatagaagatacttctgtttgggtttatctgattgtttcctcatgtttagattcaagttatgcatttgacaggagtatttcctttctaagaaaaagagaaaccaaatagaataaactcaattttattcatttgaaggcagtattagatattcctttgatgaggaagaaaaattcatcttcaagttccaaatctaaaaatcaaatatacccatatttcagaatttcatcagagatattaaaaaatttagctaagttgtatttgagtcccagaaagccaaatatatactatttacctaattgttatattaatatttgagtaagtactatatttaggctactacagtagacccaggactctgttttgttataaacactgatattcagtcacaaatatggataaacagggtttcaagatgattctttagaaatgttcagtcagtaattacagcttgatgagtatgaaattgtaaactatcaaagataccacagtaggtaaatattaaagacataatacattctaaaaagtgggtgaggctgagcgcagtggctcatgcttgtaatcctagcactttgggagctgaggtgggtggatcacctgaggtcaggggttcaagaccagcctggtcaacatggggaaaccccgtctctactaaaaatacaaacgttagagtttctgtttgggatgattaaaagttctggagatggatgaccatgatgtttgcacaaaaatgtaaatgtactcaatgtcattgaattgtacacttaaaagtgtttaaaatggtaaatgttatatatattttaccacaataaataaaatatagactggaaaaaaaataaataaaaataaaaataaaaatacaaacattagctgggcctggtggcgggcacctgtaatcccagctactcaggaggctgaggcaggaaaatcactttaacctgccgggtggaggtccagtgagccgagatcgcaccacttcactccagcctgggtgaaagggtgaaactccatctcaaaaaaaaaaaaaaaatgggtgagggatttcgatcgaagctgtggaatctgctccagatctcaggttgctactatagcatcttgggtagatcactcttctccagtaagccctgggctttctcaaaccttttctgtacaggaagcctgtcccttctgccatcctggtcaactctgcctaccaaattcctgcccatctttgaaagcgaaaccctaacctaggctcccctcctttgggaaacttcccaaggcctccctccatgctacatgatcatcttttttttttttttttttaagacggagtctcgctctgtcgcccaggctggagtgcagtggcgcgatctcggctcactgcaacctcagcctcccgggttcacaccattcttctgcctcagcctcccgagtagctgggactacaggtgcccgccaccacgcccggctaattcttggtatttttaatacagatggggtttcaccatattagccaggatggtctcgatctcctgacctcgtgatccacccacctcagcctcccaaagtgctgggattacaggtgtgagccactgcgctcggccgatcatctctttttacagactagacatccttaatcacaagtatcttttttttttttttttttttttttaagacagagtctcgctcttgtcgcccaggctggagtgcagtggtgcaatattggctcactgcaacctccgtcttccaggttcaagctattctcttgcctcagcctcctgaatagctgggatttcaggtgcatgccaccacacccagctaatttttgtatttttagcagagatggggtttcaccatgttggccaggctggtctctcaatcctaacctttggtgatccacccgcctcggcccccaaagtgctgggattacaggcgtgggccaccgcacccagccaatcacaagtatctttataggacatctttattttttacagaaaataaagtactagcagagtacttggccttcagtcgttatttctttagcccattagtaatgaataaagaggtttcgctagcaagaatgaaagaaaggactaagagaagctctactattttctgaaaggtgataaaacatacaatcagataaatttccttttaaaaagactttcaaataaatctttagaacctgcaaaccctcccacaaagaaaatgtaaacactgaaaggtaggaggcaattttactttatatttctagtatcaccacagcttttcattcaaacaaacattgccatgaagttagggaaattcctgctgcattcacttgttactttttttttttttttcagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaagtccaagcaatgtgacatccgtatttcacaatatttctggtgtatcagttttgtatgttacatttccattttgggattctgctttatgatactttactttcttacattttgcatttttgttctgtaaaagatcactgccaataaactgcaaaagaccaataaattgcatatcttcagaaggatttcacattttaaatcgtgcctttaaaactgctttttccccccacatagaatccattttagagttagaaaagtgttctttccaagtgttaatagtttgtcttgcagatggtaccattttatgtcaccaatatttaatatgagaaaaaacaacctgtttaaaaaccttgttttgtatatcagttatgaaaatatctggtagttggaaatctctttaatattcattttaaaagaggaaagggcatcttttccggggggaagctatattttattaatcagaaaaatactaaacaaatgtgtttgtagggaatattgagagtgaaaaacaattgttgaatgggacataagccaaaaagacaatgctttttattatttacagaacgtaattctttagaagagaaaaaaaatacataaatcattcatttgttcacctagcctggcactgtgcttggtgctggagatacagtagtgaataaaatagccagtgccttgtagagttttgtgcctgtctactaggaaagacaggagattatacagtaattatataagatgcaaattgtgatatgccatgaagaaacgtatagcattcagagggacataacacaacacaagacataccacataaaactgattttttttaagatggtctcactctgttgcccaggctggagtgcagtggagcgatcatagctcagtgcagtgtcgaattcctgttcttaagcgatcttcctgcctcagcctcctagtagctaggattacaggcatgtgccaccatacccagcatgtttttgtatttttttagagacagagtcttacaatgttacccagactggtctcaaactcctggcctcaggtgatcctcccactgggccataaacttgattttaacgtgggaaatgggaaagcgtatctcaggacatttttgaaagcaagttgattaagaaagtaaagaaacagaatggctactccatagagcagcctctgaggacatttatagcttttgcagtgacatggttgtctaagtgaatgatggtgatggtcataaaagtggagagaaggggatagagtccaggtgaagtctgacaggatgtagtcatggtttggaagcggaaagtgaggaagaagaaagggcttctggcaaaaaaggctttagcctttatgcatgcaggatccctggggggaaagagtgagttcaggagcatggcttttagacttaccaggtttacaaggcagttgtatctatggaactaaaaaatataaattttgaagttgtatacagaaatggtacttagagccatagaatgaatgaaattgcttaaggaaaatgtagtgtgagataaagatctgaggaactccaacatttagggctgactagatcagggtagctggcaaaggggactgcggagttggcagtgaggctggaggaaaacctggcaaaagggactgaggagttgacagggtaatgtcaaagttgtccacaggaatctccaggttgaggtagtcaaatgaacacttagatgaatactgaaaagtccagtggatctagcaatatgaatgtcacccgtgaccttagcaaaagcacttttgctggaataatggggaaaagccattttggagtacgttgaaacaatgaatgggaagtgagaaagtagatactggatgtatagcagtttttccaagaagcttggctcagaagggtagcagacaggatgacaagtggaaagagaaatgaggtcactggaggattgttaaagagtacagcatgtttgagtgtcacttgaaaggttccagtggagaagctgaagaagtaggtaaaggtaagaataaccaagggacagaagtcctggagcagggaggagggaatgggattctttaaaacctcttcatcaagaaactaggaaaaaaaaccaaagttgtaccatctcagatttcagagaaagggaatttagaaggaagtaatataagcaaagagcaacaatattctgtgactgtttttaataataactaggaaaattcctagtgcagttaactctgaacaaaattcattcccacctgcataatacaagatagacttactcagagtgaccttggtaaaaggtgtgataataaagaaaggaggtgtcattatgtcttcattgtagctttatatgaagccctggtcatttaccgtatcagcatcagcaaactgaacactgaatgattcttactccaagaggcaagtcttagtggtttctattttaactgaaggagagattaatttctgtgcaaggttgaaaaaggtgaccacaaattctttgggcttctttcatcaagaggtgaagtccattaccccacgccttaactctgggctggctttgttgttgttttggccaatagaatatggctgaggcgctgcttccaagattaggcctgaattgagatgccctagcagccaggcagcacctgccagagcatgaataaggctatcttggaccgcccagcgtagccaacctgtgctgaatgaagccacatgaatatgcccaggagaaactagcagaagaatcacccaccttgcccacgttagagatataaaccactatttgaggcagtttgttatgcagcaaaacttagccgaaactattaccttgctaccttgactgctggtgtaatttcccatctcatggagtcacagagttttcttgccaactgcagtgagttggcaaatgggaatgatcagtagcctcagtgtgttttctgatccactccatcctgtattatcatctgcgaataccgtttttcctttaaatgcaatgtgtctttcaaagctgacttgaatttctcacctttcgagttacctgccatttggactcacttatttggaggagatatgtaaagacccagcgtaatacctgtatgctcaataaaaagtatttgctggtactccttcctgcccgtcgtgtgacctgactgctctgggcttctgggggctccccctaaactcgctccacgaaatgacccctccaacctggcacgcccgctctcctaccttcgcccagggctggccgttatctctgtgctgtcacgcggggaagtcccatctgaactggggccttatgaccttcggtacttttattcgaacgtagcctgcgtccctgcctggaacctggttcccgccctgaaggacccttacttagcactcctgcgggctgccgggaccccacggctccgcaggcggagagactaggcgcgatccctgcgcgcccctccttctcttgcgcttcagggggccggccctcagggggcggggcagcatcgcgcgcaaggcctgccggttgctcggggtcgtatgacgcacttttccagctcgagccctcacgaggccgtgggtacgaccggaagccgcaggtgggtgaagcggaaacgcttcaaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaaggtaaggaagtcttccgaggaaaaacttcaaaaaattagtcattaaagggtgagagtagaaagattcaaagtgattttgaaggaacaaaatttaaccagaacttcaaaggcttgacactatcccaacgactgtgaaatatcctgaaataccgtgcattactcagtcggggtctgatccgctactggagcatagaataaaaaaagaggggcacacctgtgccagatgaatccacgccttctctaggggagagagggtatcccggcttaagagcaggggctctcctgagttaaggaagtgtcttccccagagcccattccgtcagacgttcatatcatgtaactcagtccttttctgattatgtattcaccaagcaaacttaagagttggcttgtcaccagacctacagtgaataattgcacaggctcatctgaatatctgatagatggtctatagttctctttgtaaatcaataagctggcagtcagggatttttggacatccctttgttttcactttttctcactctgtgtgattttttcttatctttcggggttcaactgaaatgtcacatcctcactgaggtctgtttattggtttacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgagtagctgagattacaggcgcctgccaccacgcccaggtaatttttgtatttttggtagagacggggtttcaccatgttggccaggctggtctcaaactcctgacctcaggtgatctgtccaccttggcctcccaaagtgctgggattacaggtgtgaaccacctcgcccggccatctactttttttaatagccctccttatcacctttattcatttgactcactgatgattcccaagtgctaagaacaatgtctgtcatgtaattgatgaaaactttgttgaattaatacctttgttgtgttttattcacactgtatatacaatacctggatgaagagagatatttttagcactattaaaatacatgcattggctcaatacatgaattggatcaattctggaaccctaacaagatcacatttttgaccaaagtcaatatcttggactatagttaatttatcaaggtaaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgccttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgtgtactttcttcagtgccaggcactcttctaaccactttatatgtattagctcatcagactcagcctgataatatgagatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttaggaggccaaggcaggaggactgcttgagcccaggagtttgagaccagcctggacaacaaagtgagattcatctctacaaaaaaaaaaaaaaaaaaaaaatagccaggcgtggtggcacatgctggctaaagggggaggattgcttgagcccaggaggtcggggctgcagtgagccgtgatcacaccactgcactccatcctgggcaataaagttcaagcatttcacttggatttaaggttctttataatctaacatctacttctcttgccttcttattaactccccattcttgtattcctaataaccagccagtagaattaaattatttgcatgggtcctatctccttttccactaagctgttgcacattgttagaattcttttctttatcccttttatgtctcagcttcaatgtcacatccactaattagagcattagatggcgctctactgtacttaacacctatcacagcatttaggacactgtattttaattattgccttacttgttttttagtatctcccactagattgtggaggtacttgtttcttgaaggcaaggacaggttcaccttcttttctttttttttcttttagacggagtcttgctctgtcgcccaggctggagtgtagtggcacgatctcggctcactgcaagctccgcctcccgggttcacaccactcttctgcctcagcctccagagctgctgggactacaggcgcccgccaccatgcccggctaattttttgtatttttagtagagacggggtttcactgtgttagccaggatggtctcaatctcctgacctcgtgatccgcctgcctcggcctcccagagctgctggtactacaggcacctgccaccatgcccggctaattttttgtatttttagtagagacggggtttcactgtgttagccaggatggtctcgatctcctgacctcgtgatccgcctgcctcggcctcccagagtcctgggattacaggcatgagccactgcgcccggccagttcaccttcttaatgtcactcatatccatccccttctctctctctctctctcctaccgtactttaggccctcattatctctagcatggacaactgccttagtccattaactgttccccctgtccctagtccatcctttatttaatccatactcaaccctgcagaggcagattcgtataacagctgagttaacacttcctgcttaacacttcagtggatcttagctgccttttaaaaagtccaaatattttggttcattacatgaatttatctcctcccattttctatctccttattaccttgtacctagtaggaactccataaatacttgttgaatgaatatggtactgtgtcaaagtcagtcaagcagaaccaagaacaaagaggttaaccaaagtaatgcagtctcggttgcgaggcttcctaggacagtatagccataggcttaagtggaagtcgaagactagtagtgtaactctttctcttaggagggaatccccaaacataccttactattagatgactctttgtctttgcatatgcctggaatatgctcctcgacctggcaaacttatcagatttggtgactcagttcaagtattccttcctctattaaacctctccacacctttctagacagaatgtaaactgattcaactttttgtaggttagtttataaactacaacaagagtgatgaaaatatgaagactctttaatctagaattgtacttctaagatattacttaactaaatgatttggggccaggtgtagtggcccatgcctataatcccagcactttgggaggctgaggcaggaggatcactgaagcccaggagttcaagatcaacctaggcaacgtagggagacccccatctctacaaaaaatttaaaaattagccaggcatggtggcgcatacctgtagtcccagctgcttcagaggctgagatgtggagattgcttgagcccaggaggtcgaggctgcagtgagacaattacagagtgataccctgtcttaaaaataaaaaataaaaaagcctagctacctagttatgaactttctttatttagaaccaaactcttaacctcaagttatacactttaataatccattctattcccagttcttcaacctgaaggaaaattatattctaagaaatagaattggaatagaatgatttaagaccataagtaatcaaaatacttcattttcatagctagtattttcaaccttttgctgcctaatatttcattagcaatggtaacatgaataatgtggaaagcatccaaacatagtgaatttattcttagcctttgtatataaacctgcatactcccagttgcctctctctctgacctcaagggttcatcctaagttaatattgatctaaataaaagttatgctgccagtaaatcatatatcccaaagtcaaacaggaaattatttttaaagtgttataaagacataatgaaagctttccacggaaatgttcatgaacacatcgttgataaccagaaaaactagaagccacctaaaattacagactaagagactgagtaaacttgttaacaatggaatattaaacagtcattaaagctgatgcaaaatagatttaatgggccaacgcggtggctcatgcctgtaatcccagcactttgggaggctgaggcgggcagatcacctgaggtcaggagttccaagaccagcatggccaacatggtgaaaccccatgcctactaaaaatacaaaatttagccacacgtggtggcaggcgtctgttatcccagtgaggtaggagaatcgcctgaacctgggaggcggaggttgcggtgagccaagatcacgccacagcattccagcctgggtgacagggcgagactccgtctcaaaaaaaaaaaaaaaaaaaaaaaaaaaaaaaaaaaaaaaaatatatatatatatatatatatatatatatatatatatatatatatagattgaatgtcgaatgaaataatagtatggggagggaaatgtgtgtgcgtatacatgcttagaaataaaatgggtttacaccaaaatgttaattgtgattaggactatcaatgcttttatttttttcttcttgcttgtctgtattttctcatttttctcgatgaacatttgttacttgtgaattcaacataatttggctttaagatataggtaatgtggctgagtgcagtggctcatgcctgtaatcccagcactttgggaggccaaggtgggaggactgcttgagcccaggagtttgagaccagcctgggcaacatggtgaaatcctgtctgtaagagaaaaaaaaaagatatattacataatgtatttgcagcagacttattgtttgaaaactgtgaaattatttcaactgaaattatttgaaatttgtcttcatttatttcttttgaatacttggttatagcattgctaaagactaattgtaaagctaaaagccaaaagcaactgcactggatactttaagtttggattaaataaccgataattgatagttagaaaatagaatttaatgttccttttctcgatgaattaatttgtttgtcttccatttttaaaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaaaaaaacctagtctcttttagtaacgtcaaaaaaaaaaaacaaaacacaacaacctagtctctttcagtaacttctccccatctgaaattctttatcacctatccctatctgtgtatttcttctgacctctaggatcctctttcttctctttcttccttcatttattttattttatttatttcatttatttattttgagacagagactcactctcacccaggctggagtgcagtggtgcgatcttggcccactgcaacctttacctcctgagttcaagtgatcctcatgcctcagcctcccgagtagtgggactacagggttttgtcaccatgcccagctaattttttctatttttaatagagacagggtttcactgtgttggccaggctggtctcaaactcttggcctcaagtgatccgccgacctcagcctcccaaagtgctgggattacaggtgtgagccaccatgccctgtctgttcattgattttaatacctggcatgtatttatatttcagctgctgctgcttttactctcttggggctatatataatattggacactctgacctcagacttagttctctgtttttcttatctctcggagatataacccagatttcttgccacctctcctcatatctcaaactctaaaattctcccttttagttatattttcttatctttctactctcccactaaaaatcaaggctgttgcacttttctaagctcttaacccttccctaatctctccttgcatcatttcccttctatcccagcctgaaatttactttatgctttactttcttaccagtattctcatttgcttctctcctttgaccttctaccatagccactttttaattttagtctaaacaattgattttctactctttttggcaggtgatgctggggggaaagatcatataatcattgaagattagcccaatttgatatttataattttcaacttatgtatctttctgctggtgtcagatttaattcatctctggttgagttcccctcattcttaaggggaatgtttccactcttctcaagctcagaatttcactactcttaccttgtcacaaaccttgattcataatttggtgagagttgaggccttcagaaatgagtccctccagcccccatggcccccctcctcccctctccactccctttctcttctttcaagacagggtcttaccctcacccaggctggagtgcagtggcatgctcataggtcactacagccttgaactgggctcaagtgatcctgttgcctcaggttctggagtagccggaactacagatgctcaacaccatgcccagctccctctgtttatgagttattttcttttaatatatctcagtagttccaggccccatcctttttttatttttaggaagagcaggcatggacacagggttttgcctacaattgattatctcagactgggggtagggtgagtgattttatttttcaaggtgttcttgggacaaacatgattggcagtttagcaggtttaatgggcaggtccttttgttatttaaaagcaatattaaataccaagtaaacacaactttgaagagattactcatgaacatttcacacttgttaccacctatgaaaattattttttgagaaaggttaaaaatcctgatatgatgtgctttggtgcagtaataccatgtttctccagagagaggatatcatcaggcaaagggtgttaagggcttcgagttccaaattggaaatttgaccaagtaacccctgaaacatatggactcaaggtatgttttgcagtggtttccccagaactttctgaatgtttgcatatggggatgagagaggagtcaaaatggcatacacacacacacacacacacacacacacacacacacacacacatatatatatagtcttatttttttgagacagagtctcattctgtcacctaggctggaatacagaggtatgatctcagctcactgcaactgctgcctagtgggttcaagtgatcttcctgtctcagcctcccaagtagctggaactacaggcttgcaccaccacgcctggctaatttttgtattttgagtgcagacaggtttcactatgttggccaggctgttcttgaactcctgacctcaggtgatctgcctgcctcagcctcccagagtcctgagattacaggtgtgagccactgcacctggcctttactcctagatttcttatgagattggatggatgggagtatacatggggagtagggcagtgtatatcaaaagttaggttggggtgtattatatttgaaatgtttgtgtgcttctgagatgtcatacaggcagttgaataactccaaggagaagtcttggcttaatttataaatttgagggctgaccgcatataaatagtattttaagtcatgagaatgaataattttagacttttataattcatctaaagtttaaattttaaactattaaatattcagcatctgggtccccttatatgtttgcggacttctccacctggtaggaggtagagcctacttccttctatggaaacaaaagtttactatactctttgctggccttccttgaagctcagacgtgggcacatgacttaagctgtgccaatcagatgcaactgctccatattttgaattagacactagtgatgcagaacatctggaatgatgagaacccttctctggaagtagcgacaggggcctgaatttctggggtaatgaaggcagtgaggctagcgtgatagtttccaagccagtgatatcagtggtgtaggctactgcatccagcccttgcatcagtgtcagcaggggtgtcatctgattagttctgggtagtgattctagatgtgatttttcactccaaaacctctgtgtctcagtctatagctcaactacctactattcttataataaaccccttttttgcttatatcaggtaggagcagtttttgttgttttttactaagaacacttaaccatgtaatcacttagggaaagagtgtgaattaaaaaaaaaaaaaagaggttactacctagtacctagcttgggagaacttcggtatttaaaatgtaagaagaatggaggaagagagtgtgtttcatgaaagtcaagagtttcaagaagggagtagccaactgggtcaaatgcttctgaaaggtcacatagtacgagagtttaaaagtgcccattgaatatggtagtacagagatcactgttgaccttagcaaaaacgatttcagtggagtacctggggcagtcgccagactgaagtgagttaaagcaaataggtggtgaggaaataagaaaaaaaaaaaaaaaaacatacagagaacactctttgaagaaatttttcatgaagaatgaaaaaatagggtggcatctggctcgagatgtgtgtactaataggaatgatgcagtacagcaggagagattgctctaaggcccaagtccttgtggaggctaaaggaggtcagatcaaggtcactgctaaaaatctggccatcatccttatatattaggaatactgactctaattttataaatttgatctctcatttttttaacttagcttatgtttccttttactcaagttttgtatatttacatgaccaagtcttttgctcttaagagttctggggctttctgttatactcagttcattaagtggggttttaaatatatatatatatatatatatatatatatatatatataaatttttcattaattagctctgtaatacgtttagatttctttgtatggtgtcaacatcattacagaaaaatttctttatgcggagtaagacagaggccttaatgttattttttccaaccatttgttgagctctttctccactaacttaaaatgtcacctttattacatattaaatactcattcatacacaatttctctctttcaaatgtgtttctggactcttttattctatcccactgatttatttgcccatgcctatgcccatacatttttaagaaaattattgtagctatgtctttatagctggtcaagcaagtctcctggtgttactctcttttgtcatttaatttataaattaagttagagagaactgacattaagtcttcccattcaggaatacaatttgtctttctagttaccctaattttcttttatgtccctccataaagcttatagttgttcatatagttcttaacacatttcttgatatatttaagctgtacctggtaggcttctggtgctctaattagatctggggatagaactccaaatatctagaatggatagcatgtctgtagactcttttctttaaatatcactatgtcttagccaggatttttatagaagttggataaaagttaattgcacagggttgtggattgctaattctccatagtaacgattcatatgctttagaaatcagaattgttattttaacatgaaggtaaagaggcctaacacatgttcttaccttaattaagagccactccatttccacgtggcatcgggtactgggcaagataagcaaagatactctgcagaaaggaacttcggatcaggccaacacttgttcaagtgttttcctgagaccctgaatttccatatgatacagcttagtaaattagtttgagtctaaaatttttcagattcagtattatcagcacctgaacctgaaaagatttaaaaaaaaatcaggaactgttctggaagcccttcctggccttttatgccagctccatcttgtacctaccagctgtcccacaaaaggaaaacagtgtccaaggcttgcccaagaccactctgtccaaccttgttcccatggtctctacctttggtcctctacactgttttaactctgttgaatagtcctcagatgtgacatttatatgtgcactctccaatactgaacactggtactatagttttcctcttacatatgttagcttagctgggtttttttatttgtttctttttttattttgagatggagttttactcttgttgcccaggctggagtgcaatggcatgatctccgctcaccgcagcctccacctccagggttcaagcaattctcctgcctcagcctcccaagtagctggaattacaggcatgcgccaccacggctggctaattttgtatttttaataaagacggggtttctccatgttggccacgctggtctcaaactcctgacctcaggtgatccgcctgcctttgcctcccaaagtgctgggattacaggcgtgagccactgtgcccagccagcatgttctttgagctgtggaccgcccactacctctagcatacaacccctcttcagcctgtctccatggaatctattctgtctccaaccacacaactggcatctggatgaaaagcttacccagaacagttgattctaagctgcaaggctttacaaatgtgccagccaaagtgaatgagctgcaaaatgcatttggataactgaatgggttgatttgccttcatggagttaggtaatactgcacaactgcatgatggtaaatgtttaccaaagacaattctcttaattgtaacaaaattaacattttactttcctgtttattagaccccaagcccatctgtctcttttttttcttttgagacagggtctggctctgtcacccaggctagagtgcagtggtgcagtctcagctcactgcagcctcaacctcctaggctcaagtgatccttccacctcagcctcccaagtagctaggactataggcacatgccaccatgcccggctaattttttttttttttttttttttttttttttttctgatacaggttgcccaagctccatctgtctctttaaaagcactctaatccatggtgtctttccctcctggacttaaaactcccacaggcaaaattaagatctaattcatcttcctaatagatgcttattatttgttgacatgctcccgcagccaagtaacagagaagctggtaaaatgtttaaattagctgtattacttgaaagaaacattgtaaatctgctgagtaatatatttacaaaaatatttaggattgttcccacaactgaatgatggatccataaattagtagaaatataaaagtttattgttaaattcatacattataaaagtgatcttttaaaaaaaatccaatattcacttaaagtagacataatacaaattaggctaccacccatcatatattttttgtatgcttcttatgaaaaatgtctactgttgtttcatgacatggtcttaaatcaaaatcacaatatccaagggaaaaacgactctaagaagagaagaaaagagtatcattaaaaatgatacaaaaacagtgctacacatttactcataagattatatcctacctgtggtttcttaaaataatcaagtccccttccaatcttaatcatccatccattgttgaacctgttgaaattagtatatagtattatattcaagacatttaagtcagactattaataaagctgtagtgtattaagtgtcagcaaaatttccccctaacaaagcaaaccacttcctccagtggcatgagttgaatcaaacctggggttcattatgagctgtgtccacaatgaaaacagtcatagaaacaatcagttgatttaattatctgatagtttaatcttgaatttcagcttgttgataaaactttttcgtgttctgctaacaagtggtggcaaagtgtattcagggaaactggtggtgtttcaagagttcccctacctagagatggggaatgtgcaggaggagccctggaccctgacctctgctttaactacagcagctgcattttcatctgttttgcatatttagtttgtgattaagtttttattaaaactgagtgcccttgctataaacataaccactgtgctaaacaaaaggaagatatcactaaaataactgcatattctgttttcttatagactcagcaaattgtcatgcctactagaatatttaataacccctaagaagtaaagccacattaagtaaatattaagttcactagaaaataaattatcctaatatcataacactatatatacagttgagtagacagaaaagtgttctctttttctatatgacacagaacatgtaaatactattccattaggaaatattaaactcacacacaaaacacttggcttactttgtcaaaaagaaagccaagtgttttttttcttctcaaaagtgaaaaagtactaaatggagttttatttgaattttaaatatttataaattattaaatatttataggcaattatataaaacatttacaaaaattttaagtatatatcaactgcataaaaattaaaacattattgtagactaacctaatttctcggtcatgtattgaagaagagtattgaacttccaacagcactccgtgactcctgagtgactcttctatttcttgcaggcctctactttgctgcacttgctcaatgccctgttaatagcaaaaatacgattatctgccgcagttattattactatcttaaattatccctaagctatacaatctatatcacaggtggattaagatggaaatgttctatactagtttcaatgtctattatctcaaaaaaacaaccaatgtgaggtagtttaaagagcaattatttttatcaaaatcatctttttttctaatgtgaacataactccatcctgtctccttaaatgtagtttagaatagttttaatcatccaggtggagctgactgcttttgaaatcaatcgtagaaatcataattatttagaagcattcttattttaagtcaaaaccaagatagagatgcccactaccatatcatatcatgctaccatcccccagatataataattggtaaagaaacaaaattgttcatagtgcagacagtgtgattgcctcctagaatatccaagagactaaactaacaaactatttgaataagtgcatttagcaaagtggccaaatacaaaatcagcatcctaaaatcaataactttttttatgacatgttatgcatactgttagataataagttaattcccaaggaaacaaatctagctgaagcactgcatctgtgttctccttgactggactacatcttgtaactgaataaagttaataagaaagagtaagtgctttcaggtacctacttcatccagagaggtgagaaggtgaatagtttttactttacatggtctcttaataagcatctcacaaaatcgaagaaagttatacagctaaaagacattagaatggattattactaatttagtacattgaatatgatatttcattatattttagtatgttcacatacctgatgagtatgtctaatataaggatcttctatccaaacttctgtaactgtctcattaaggtattcgcgaaaaagtgactcataactgaaacctgttgcattctcttctattttaatttgcttgtgatattttccatctataaaacacaggcttcaacagtaaaaccagtgaccattttttttttacacattttatattttatatagagtgattaatcagcatcagatacatattaatttttttaacttattcagcaaatacttattgaatgcctactaaatatcatatacattgcaggatgttacacgtacaaaggtatttaaggcaaaccactccattagtgatttctgccttcacagaggctaggcaagggggaaaatctagaggtttcctggaacaggtccttgagcaagatcctatagaccaggcagtttgttgaagggagtagtgtatatataaaggtatccaataactccctgtcgccatgggtagcaccacatactgaaactcagtggctatctggtcctcctcttcagacttgtctttttatgtcttgcaatctaataactaaagtgagtattaaacatgaatgcagggcagagcgcggtagctcacgcctgtaatcccagcattttgggaggccaaggtaggtagatcatttgaggtcaggagttcgagaccagcctggccaacatggtgaaaccccagctctactaaaaatataaaaagtagccaggcatgatgtcaggtgcctgtagtcccaactacctggggggctgaggcaggagaatcacttgaacccaggtggatgttgcagtgagctgagatcatgccaccgcactccagcctgggcaacagagcaagactctgccttaaaaaaaaaaaaaaaaattaatgcagtataatatgaagcttcaaagtctttcttggcacgtgtacagttttaaacagaaatttatagtacttcttaataagctaaagactgggatgtcacaggatcaagaggatagatctattgcttttgttcattcaaaatgaatattgaaaaagttatcagaaacctttaaggttttaaaaaaatatgacccctggctgggcatggtggctcacacttgtaatcccagcactttgggaggctgaggcgggaggatcacctgaggtcaggagttagagaccagcctgaccaatatggcaaaacctcaactctactaaaaatacaaaaatgagccaggcttggcggcgggtgcctgtagtcccagctactcgggaggctgggacagaagaattgcttgaacccagcaggcagaggttgcagtaagcagagatcgcgccactgcactccagcctgggcgacacagcgagactccgtctaaaaaaaaaaaaaaaaaccctaatggtagcccctaaattatactttacactttgtttaaaaatcagtagtttggattctgttccaaatatttccacatagataacattggcaactatgccttattttttaagccaagatagccgtatagaggttaatttaattccatgtactcaaaaccacaatgctggaggtactatatttcatcaatgttttggagtaaaatttcattctaaatttcaaatcggggctaaggaaacataactttattcccactgaacaaaggagctcagtggggggtccccagggtatgtactgatacaggatagtaggaagagatggggaaaggggtgtagaaagtatagagaggaagaaaagctggggcctgggggcactggcttttgagggcagcagtacctttggctatagaaagcagcaagtatgcactcaggtaagggtggaaatggccatttacagacatttgtaaactggatgcttaggagtagggaactaataatagggaacaatacctacctgacctctaatcattaggaatgcttaactcctgaggtgttttgattcacaacaaaatctgagagaaatcccaggagtttctttagcttctttcatgattttggtcatttcataaagggaaatataaataaaatacacaatttacattcagtattccctgtagtatttcttaacatagggtccacacataagcttcatagggatttgtgaaccccttaaaaatggcatggaacattctccagtaagtatagctttcatgagatgttcaaaggggtgtctgatattcccacccccaactaaaaacaaaagccaaaacaaacaaacaaacaaaaaattaagaacaactcctgtatgggagtggaaatacagattaaatcctgtaagctcccagggacaactggtccagaccacacagagctccaaagggcaggagccagaaacattgggtgaatggacagtcacagttgtttatggatgcattttctaaaacaacctctttaccttctttttcttggtccaagtacttctttatgttttccgctctgtccatgtatttggaaattttttctctgagattacatctcttagtattatctttggtacctacaaatttaaaaatatatattatcaagtatcaaaatagtttttctatttaatttgggcattattttcagtttctcaagttttctacaaatttcctatcctctagtatggcttgcctcagtcctcaaacacacacaataaactcaaatttggcttgaacatacaagaccttcatatttacacgaagcgtgatgcagcttggtttaggagtgggagctcttgacactatgtctcatctctgggacatcaaatctggtgggatgaaaggtggctcattacatgtcaaactcatgtctgagcactattttatcctaactacccacaagtttgaaatttttgcataattaaaagtagcaaaaaatatttatcttccacaaaaccagctactcttccagacctccccattatagttaatgcacatttttccagctaccacaaaaatgttatttttgaatatacatgatcataaagttttacccaaccacccctcctcccaaatcagtcaacaaatcacttcttgttccttcccttttttcctttcaacatcgcttatattttccataaataatctcattttttgtttgtttgttttgagacggaatctcgctctgtcgcccaggctggagtgcagtggcatgatctcggctctctgcaacctccacctcccgggttcaagcaattctcctgtcttagactcctgagtagctgggactacaggcgcccaccactatgcctggctagtttttgtatttttagtagagactgggtttcaccatgttggtcaggctggtctcgaactcctgacctcaagtgatcctcctgcctcggcctcccaaagtgctgggattacaggcgtgagccaccgtgcccggcccatttttgtatttttagtagagacggcgtttcaccatattggttaggctggtctccgactcctgatctcaggtgatccgcccacctcggcctcccaaagtgctgggattacaggcgtgagccacactgcccagccaataatttcattttaatctctcattttaaaaaacattttgagttaattttttatatttacagaaaagttgcaaaaatggtacagataacctccttcacctagattctcttaatgttaacatatcacaaaccatactacaagtatcagagctaggaaattaacactgaaacaatactatgaacttatctacaaaccttatttgaatttcaccaattttcccactaatgaaagtttgctttctggtccaggatcccatattgcatttagttatgtgtccttagtctcctccaatctgtgttagttccttaatctttctctgccttctatgtccttgacatttaggaataatattggtcagttatttttgcagaatgtctctcattttggacagtctgatgttttctcatcattagacttggtttatgcatttttggcaagaaaatcacagaagtgatgtgccttgctcagtgggtacatgatgttgatgtgtcttactgctgatgatattaactgaccatttggtaaaggtgtagttcagatttctccactgtaaaatcactattttctcttttgtaatttgtaagtaccttatggaaagatatcctgcttcccatcactctttctcccactaattttagcatctgttgatggtccttgcctgcaacaactatgactgtgatgtttgcaaaatggtggttttctatttccgtcattccttctcaatctatttattcaattaaatagtatgggctcagggatatttattttactctatgagttataatccaatactatcattttcctgctcaaattttatcagctttggctttgacatctccttcatgttagttcctgtgtccttttgtcaagcccgcatcgctattatgtccttacattttgattcaggatttttttgtttcattttgtttcgctgagacacagtctggctctgtcgcccaggctggagtgcagtgacatgatctcggctcactgcaacctctgcctcccaggcacaaggaatcctcccacctcagcctcccaagtagctgagactacaggcacacattactatgcctggctagtttttgtatttcttttctattttctgtagagatggggtatcaccatgttgcccaggctagtctcgaactcctgggctcaggcaatccgcctgccttggccttccgaagtgctgggattacaggcatgagccaccatgcacagccacaagatgttttaaaccaaatttgtccaactcttgcatgtggcccaggacagctctgaatgaggcccaacacaaattcataaactttttttttttttttgagacggagtctcgctgtgttgcccaggctggaggcgcaatctcggcttactgcaacctccgcctcccaggttcaagcgattctcctgcctcagcctccggagtagctgggattataggcgcccgccaccacacccggctaattttttgtatttttagtagagacagggtttcgccatgttggtcaggctggtcttgaactcctgacctcaagcaatccacccgcctggggctcccaaagtgctgggattacaggcgtgagccaccacacctggccattcgtaaactttcttaaaacattatgaggggtgtgtgtatgtgtgcgtgtgtgtgtgcgcgtgtgtgtgtgttttagctcatcagctgtcgttagtgttagtgtattttacatgtaacccaagacaattatttttccaatgtggcccagggaagccaaaagatttgttaaaactcatcttgtttattttttgccccagccctgaaatacccttttccaaggagcctcggtcacttttattgaagaatggcattgagaaaccaaattctgggtgccagctgtgttcattgctgctgggggagtcccaccactacttctagaccctctcagtcaatacagctaggaggtatatgtaggcttactaacacatacatctatatatacatacatctatatgtatttgtttctgtccatctatataaatattaaaaaccatgagttcatgctgataactttgattccacagagctcattctagctttcccccatccctctcctgcccaaataaaagcaaaacacaacctttcctcaaccttgctagactttaaattatgtagtagttcagtcttagtcattgtccttgatcagctggcagtgtctcacacatagacccatccttcaatcattacgctacagtttctcaggcttggacccttacagccatctttgattcccattaaccttactcccatatctaatcatgtgccagtgccccctccttatcttaatactggtatcatctccctggttcattcaggcccttatcatgcctcatctttttaaaaaggttttattaattttaattggcacataataattatacatattaatggggtacaatgtgatgttttgatacatgtatacattgtgtaatgatcaaatcagggtaattaggatatctgtcatcttaaatatttattgtttctttgtggtaagaacattgaaaatccttcattctagctatgttgaaacatacaacacattattaactctagtcaccctattgtgtaataagacaccagaatttattcctcttatttaactgtaaatttttttttttaagagagggtttcaccatgttggccaggctggtctcgaactcctgacctcaagtgatccacccacctcagtctcccaaagtactgggattgcaggcgtgagccactgcacctggcatctaactgtaattttgtaccctttgaccaacctctccccattcctcctacccactgcccttcccagcttctggtaaccactattctactctctacttctatgatattaacttttttagattccacatatgagttagatcatgtggtatttgtctttctgtgtctggcttatttcacttaacaatttcctacaagtttgtccatgtcacaaatgacaggatttcattttttatggctgaacagtactctactgtatatatgtgccatattttctttattcatctgctgatagacacttgggttgattccctatcttagctattatgaatagtgctgcagtaagcttgggagtacaaatatctcttcaacataatgatttcatttcctttggatatatacccagtagtgggatcaatggatcatatggtagttctctttttaattttttgaggaatctccatactgttttctataatggctatacacacctcttattttgattccagcaggagctccttaattggtctgcttaacttcagtctctacaggttaatgtctactttacatccttgccatattcagtcctttattcaagaaatatttattgagaactaacaacatgcccagcactgttctaagtgctgtggatacagcagttcgtaaaacagacaaaattctcttctattgttcaagtaggaagagaacaataaaaataaattggcaaaacatgtatattagattgaggtaagtgctattaaataaaataatgaaggaggacagggagtgctgggatggggttataattttacactggaggtctgggaaagcctcacaaagaaggtggtatttgtgtaaaggcctgaaataggagagagagtgtgccatgcaaataaatatctgtgagaaaagagcacattcctgaaagagacaagccctgaaatgcaactccaattatgttactcctttgtaaaaaccttaaatggtttctccttgcctgtggaataagttaaaatctcctggtagtcaaggccatcctcaatgtgatccaagcccctatctacctttaaactttacttctcactcttcctcttcagatacatgctcaaccaaactacttatttcgtaagacagcacaggaatttgaagactcttagatgaatttctgacttctgaaattatttttcctccaaagccccaatcaaactccacctctacctttccaccctcacatgacctttaactgtttaaatcctcattgcgtttatctatagatatctctctcctggcacttattccctgtattagcgctatttgcattttggtcttaacccatctatgtgacatcattgtctctgtaacctctacgggatcagtgaagcaccctagagcagaactgtgattctcctgcttcagattcctagtgcagccaaaacttgagcagtgttccacctgaccaacacagtacaccatctctcttttgggattcagtataccagagtcgttggggccttgggctccgactgtgactctaccacctcctagtggcagaacttgaaagcgaacaatactttttatgctgtaaaacgagaataccatcaactcctacttgatagggcaattggtacggatgaaacgagatcatgcttttaatgttttctgcaatgcctggcactcagcactgaaacgtgatatctatgcttattgctgttgtcactgtcatcattatcatcaaataatgccccaggcaaggtagagtttacagttattttttcttttttttgagacggagtcttgttctattggcagactggagtgcagtggcgcgatctcggctcactgcaacctccgcctcccggattcaagcaattctcctgcctcagcctcccaagtggctgggactacaggtgcgtgccaccatgcccggctaatttttgtattttcagtagagacggggtttcaccatgttggccaggatggtctcgatctcttgacctcatgatccacctgcctcggcctcccaaaaaagtgctgggattacaggagtgagccaccgcgcccggccggtagagtttgtagttctgaccaaagcaccaaaccataaagggctcccctctgctgccccaaagcttctgtaacactttaattataagaagcttaaactagaaagaacagagggagcttagtccagaccgggagtgtcgggggttggggagcaggagctgatcttatcaatttaatacataaatattgagtgtctactgtgagccagggttgtgctgggtgttaaggaatatttgggtatttctcaacattgaataatacgaaaagtctcacttgtctcctccacaaccctgcgcatttctcacaccgaacctcatccgtttaagaaaaacttttcttcttctaccgctacataattttactttggcttgctttaaatgcaaatgtttaaacagaaaattaaaaataatcgtataataaacacccttattacccatcaccgaaatttttaaaattagcatttttgctcaaatagagcttcgatttttaagaaatttttgcttaaggaaaattaactaaagacatcatagcatctctttctaaaacactttggtctgcatctctaaaaattaaggaaagttttggaaaaaaaatcatattgcctaagaaaataattttaatgccccccaatctatattcaaacttttctaatagatccaaaaatgtcttttaaagttcgtacaaacccaggtcctatcaaagcttatatattacattgcgttatatcttatatctcttaagtcttttaaaatctagactagtagcctccccaccttttctaggtaacatcaatctattaaagatctaaaagaaagcggcccagttgtcctatagaatatcccaccttctgtatttaactgcttcttcgtggtgtggaaaaatcatttttaactctttcacttcaccccagacacagcaggaaccagctccttttcctcaggtcctccccgccttggctcattgctcacctttcagaacctgcaggagcagatcaatcccctcttggtaacacaccagagcctgcggataccgcgactccgaatctagttctactgcccgctttagcacagtggctgcagctgtgctctgcgggtcctgcctcagcccggacttcgccataattctggaagttctcctccgcctcaacccaggatgaagttgagcgggtctgctgcgcttccgggaagtggtcatgtgatacccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccggtgagtggggaatgagtggcggagagtgcggcattcttcgcaaggtgtatccgggaaccctctgcagatcctaattgattttccctattgcgtactgaattggccggttacggcaacctaaatgggtctgcccctgatcccgtcacattggctcccgtaaggccattggcctgcaggatccccccgtttcccaatttgcaggatccagggccacgcggctttttgtgcccagactcttggagctcaagaacggagccgccgaggctggacagcttgggaaagggaacccaagcagcattttctgtgctgctgctttattcataacttagggttgccactgggtattaaggttgcttttttttttttttaatgaagacagaaaattgcctttatctttgtattgcttcattttataatgcaaacatccaagagttggcagttagaatatttgccattttattaaaactgtgatttgttaccattttgatcgagacctaccaaaagctgtttgttctgccctttttgccaagaggcagtaatgagggctgcctactgcttgttaggcactaggagttcagagaagagacacgcttccagctttcagagatctctggtatctctgcaagagtgattccatgttttgcatttcagaagtgtttttccccctttaataattgtatacattgtcggtttagaaaaagaaatcgatttttaacattcctgttgcatgcatgctcattgtaaaaagacaaaagaactatcggtcgctgggggggagaagggggaggaaaaacgccttttttcatacccccaggggtatgttaacgtttttctgacaaccttccagagtttttctgtgatt

SEQ ID NO: 563 - DNA, 56722 bp, Homo sapiens
ccaaaaagtaatcagtaaactaaactctctcttcctatatttgattggctaccttcatggaagcaaactgtggctccagacaaacttagatactcttgcctttcattccatgaaccagatgagtaaccagtcaaatcctgacttccaagaattaaaccttagaatgaaccctttctggatctttctctttacacactgctgagaaaatcctgaaacctggataggctagaaagaggagataacagtactaataagctacttcataccaaactttagatgcttcacctcctgaccagacacagtggccatgctgcacagactaaggtctgaaaccttttaattctgaaatgtaatgcttatgttgtgctcacatgtaaaacactttgttcacattaaattgattggatattaaccaaactaaactatagccaggctgttcagagaaagagagagagagagggagagagagaagatacaaactaacagcagaaggaattaaagaagtgacatcactatgaattctacagatattaaggaaatattaaaaccaatgttataataatatataaataaattcaacaatgtcaataacaaaggcacattatttaacaacctcaaactactaaaggtcatggaacaagaatagataaccaaaatagccttatatcgactaaagaaattgaatttgcagtttaaatcttcccataaagaaaattctgaccctatattcctgcactagtgaattctattaaacattaaggaataaataatactaattctacacaaactgtttcatataattgaagagaaagaaatagttctcaacttgttctataggtcagctttctcctaataccaaagggacaaagacattacaagaaacataaactcacacaaaaacacagacctatattctcataaacttatatccattataaacataggtacaaaaattttaatcagcaagtcagatgaaatgatatttttaaaagtataatatgttatgagcaagtgaatttatgcagacttgcatggttcttttttttttttttttttttgagacagagtctcactctgtcacccaggctggagtgcagtggtgcgatctggactcactgcaacctctgcctcccaggttcaagcaattctcctgcctcagcctcctgagtagctgggactacaggtgcatgacactacacttggctaattttttgtattttttagtagagatggggtttcaccatgttagccaggatggtcttgatctcctgacatcgtgacccacctgccttggcctcccaaagtgctggtattacaggcgtgacccaccatccccaacctggttcttttaaacatttgaaaatcagctattgaaacctatcataattgcaaactgaaaaagaaaaattgtatgattatctcaatggatatagaaaaagcatttggcaaaaatctaatatttgttcctgataaaactatcagaaaaatagaaactgaaaaagacttcctcaaaatttataaatggcatctatgaaaaaattacaactaatgttttatttcattgtaaaatactgactgatttttccggtacaatcaggaaacagacaagaatgactaccctcaccacttttccttaatattgtactggaggttctagccagtgtaatatgacaagaaaataaaatcaaaggcatacaaatgggaaaataagttaaactgtgtttattagcaaataacctagtcatccatatgaacaatctgatgaaatctaaaacaaatctactaaaactaataatggagtttagaaagtcttcagtgtgaaatattgatttgaaacatatcaattatattactatctgctggcaataaaaatagaaaaataaaaattaaaaaatgtaatttacaatggcatcacaaactattaaatacttaaataaatctgacctaaaatatgcaatgcttgaacactgaataaaaacacaacattgctgagagaaattaaagaaaacataagtaaatggtgggacatattttgctcataggtaaaaatatttagtattgttaggataacacctatcccaaaatagatctgtagattccacataattccaataaaaattctatcagttttatttttgtagaagttagcaagcttattgtaaaaatgcatatggaaatgcaaaaaaaacaagaatggtcaaaataactttgaagggaaacaaagtaggaatactaacattacttgatttcaaaatataaagctgaagtatttaataggattcagtatgatacttgcataaagattgacaaacagtttaatgggtcagaacatgagttcagaaatggacaacaaatttttttaaaactcaatatcatccctatttccttataaaatgaactcatgtctacacgaatacaaaaattttaacacaaattggatcttataattaagtgtaaaatatagaactataagatatctaaaaaaggccagatctgtggctcatgcctgtaataccagcactttgggcagccaaggctggggaaacacctgagatcaagttcaagaccagcctggccaacatggtgaaaccctgtctctactaaaactacaaaaattagctggacgtggtggcaggcacctgcagtctaagctactcaagaggctgaggcaggagaatcacttgaacatgattcaagtggaatcatgttccacttgggaggtggaagttgcagtgagctgagattgtgtcactgcactccagcctgggcaacagagcaagactccatctcaaaaaaataatagtaataaataaaataataaaataaaataactaaaagaaaacaaaaaaatctttgtgactgtgttagttcattctcacactgctataaggaactacttgagacttggtaatttatgaagaaaagaggcttaattaactcacagttctgcaggcttaataggaagcatgtctgggaggccacaggaatcttacaaccatggcggaaggtgaggaggaagcaagcaccttcttcacatggcagcaggagagagagggcgagagaacgggggaagtgctacacactttcaactgatgagatcttgtggaaattctatcagaagaacagcaagggggaagtccacccccatgattcaatcacctcccaacagctccctctgtcaacactgggaattaaaattagacgtgaaatttgggtggggaaacagagccaaatcatatcagtgacttcgggccttatatgttgcaaaaataatgaaataaaaaattgataaacttgaatttatcaacattaaaatatttagtgcttcaaaggacactgttaggacaataaaaagaaaaactgcaatgccgagaccagctgggttgggacaccctaacccagcggcgctagaggaattaaagacacacacacagaaatatagaagtgtgaagtgggaaatcaggggtctcacatgagagccccgaacagagatttatccacgtatttattaacagcaagccagtcattagcattgtttctatagatattagattaactaaaagtatcccttatgggaaatgaagggatgggccaaagtaaagggatgggttgggctagttatctgcaggaggatcatgtccttaaggcacagatcgttcatgctattgtttgtggtttaagaatgcctttaagcggttttccaccctgggtgggccaggtgttccttgccctcattcaggtaaacacacaaccttccagcgtgggcgttatggccatcacgaacatgtcacagtgctgcagagattttgtttatggccagttttggggccagtttatggccagattttggggggcctgttcccaatactacaaacttgtaggaaaaaaaattgtaaatgacttattagaagatacagagaaaatataaataatccctaaactcaataagaaaacaaccaaaaaaaaattaaaaagaatttgaacagatactttactaaagaagatatatgaataaaatataagcatgcaaaaataatcagtatcattagtcattacaggaatacaaactggaaccacaataagagattactacatacttattagatggctaaaattaaagactgtccatacaaattgtttgtaagaatgtggaggatctgaaattctcattcattgctgataagattagaaaatggtgcaatcatttaaaaaaaaaaaacagtttggcagcttttaaaaatatatggaaaaaaaaaagaaatacctaccatttgatccagctattgatttgtaggtatttacgcaagtgaatatatagcctatagtcatacaaagatttacacataaatgttcataacggctttattgtaatagcccaaaactgtaaatgatccaattctctattagcaggtgaattgataaacaaatagtagtatgtccatacagtggaatcttattcagcaataacaaaatgaaccacttacacaaacaacaatgtagataaatctaaaaataaccatactaaattaaagaagccagacaataatctttatatattacatgattccatttatctaaaatttgagaaaatgtaaatcaattaatagagacagcaagcagatcagagtgattccctgtggagggctgcgatgaagttggagggagatatacatagatggagggtggaattacacagaaggagggagggattgcacaaaagcaggaagaatcttctggtggggggtgatgaatatgttcactacactaattgtaatgatggttcttcaggtgtacagatctgtcaaaacttctcaagttttaactttaagtacgtataattgatatacatcaattatacctcagttaacaatgaaaataaaaatattaaaccttttaattctaaaaaattacattcatatgttgggctcacatataaaaccagtttgatcttataaaaataactggacattatcctgtagctttactctgaaggagtatttccttatgttcttgtctaatttaaaataaatttctttcagtcttactgaggtagagataaataaaacagcaaattaactcctctgtctaaaaatgcccattactgttttcttctaaacaatttacttttcattagtaatcagatcccattttgacaatagtaattttcattccttttctctaagccatagtttccttgttcattcaagggtacattagttgctagaagatcttgtctaaatcctggaggaaaataattgacatattctaattcagtgattctcactggagtctgagaatctgggctaagcaaaatttatatgtattacttggagaagtttgttaatattatcagtacttgatccacacctttgtaaatcctaaatcctatcaggagtgaacaatctttatttcttaaaagctttcgtgtgttgatatgtaatgcatggccagtcttgggaaccactggatgtttctgaacagtaggacttcctaagaagcagtaagaagtagaaaaattctgataagtggatttacatcaatttataagatcaaggaaatacgtataccatatacatttcttcaaaggagagactcgactgtgattaacaatttagatcagtttacttctcaaagatagtaaaaagacttgtttccttaactacagaaggaaaaggggaatatgggcacttgccaaagagcccaggcaagtgtaaaatgaagtggagaagagtaaatgtttctttagtttatatcctgatagaagcatataaaatataataatatgttcagactataattatagaaattctgactgatatcacaattttaccccttgccattcgttactccctaaaaataaataacaatctgaaacagctacaaaatattggcaaaacatagttatgtcttgttttggcatgaattatttagatgatttctgcaatgctttacttaatttagcttgaaactaagaatggtttcaatcttaggctaaacattggggaattacttttgcagccaaagctcacagtcttgtcttgcattccaatagcatttcccctcccaactacccacccaaatctcattagttcccaaatcatattttagtgatcctatcaaggatcactgtatccaaaatcccttctggagaattcactggagaatgattagaatttaatgacagaaaggctagcatctctttcctcagagaatttccacactgcaatcaagcaagaaggccagggatttccattttgttaatgtgtttgactagataccctgaatatctttctattgtaaagcacctaaaattatggataaaacattgaaaaacaaatattacaaatggacagctaaactctcaataaagtaaataaaatatttatgtttcagattgatgatgagatggaaaattagagcgataaatttaggaggtgatgctgcagctttactctcagggaagaaagaaattttagtagcttggttccaatgttcacattagaatagaagatgaagtagagagtgctgatagtgaattggaactgagtttttcaggtaaagcagaaagtgctagatctgcaaaagtgctagaccttcactggaatgacagaataagaaaacataattttcctgctggcacagtaagacaacttaagccagtcgtggtggctcacacctgtaatcccaacactttggaagactgaggcagggggatcacttgaggccagaaatttgagaccaacctgggcaacatgtagataccttgtccttacaaaaaatacaataatgagctaggcatggtgatgcatgcctgtggtctcagctacccaaaaggctaaggtgggagaatggcttcggccttggaagttgagggtgtgtgagggagatgtgagggtgtggaggcactattatgccactgcactccagcctgggtgacagagcgaccttgtcacccaggctgaagtgcagtggcacaataatattgtgatgtgtatatatatatatatatatacatgtaagcttgtttattgtgactcggtctctgggtaaagagtaaaaaacatcctccttagaatttgtaatcagatgatattgaggttctatatcacatgctctgtgtccatcttcaattcctgctacagctgtagtagagactttctatgcctttagtggagtcctcaactcatgtaactgtcccaccccccagcttttctctaaagcccataacacatcttggacaatcctcaatcaatggaggatgggagttaggaaaaacatttctcaactcctttccaaaggaagattctgagggatacttgatattgtttctgagaacaccccagaaggattgagccccatctccctccagcgatgatgacagctcagtagcatactctttattggtatcatgttcttccctgcctcattctgaattactgagacccccctcccaaatatgccacctatacataagtcattgtatcaagcaatgctttcaggaaaatacaaattaagacaatgcatttcatgtcatgtgaatctgggcttcatttttttttcaattgtctataagatgtgggcatcctcaagctaaaatattggtgtcaaattatacttagatcagtggatcccctcatgcatctgacagaaacaaatgcaagacactctgatggtaaacactctaaaaccaaaccatctagtgtcattccaaataaaactcttccaaaatgagttcaaaatacaaaatggcaaaccaggagaagaaataatccattcaaagcagtatctagcactaaagattgtgttatttaactgttgcttagtggcttaaacaacactaatcatattatctctcagtttttaagggtcacacactcagtgcagatgggtgatttctttccacttccacattatttgacgtatcagctggaagacttgagggctgactggtttgaattatctaaagaattgattggggatgaagaagctgcttctaatgttatttcacatggctggagaatcggtgcttactgttggcagtcagcctgagttttttctccatatgatcttctctacatggctacttgagtgtcctcagaacacggtagctaactcctcccaaaatgagaaaaatggaagaccagagaggaggctgtaaactttttaatgacctaattcttacatcacacactttcacttcaacaatattctatctgtcatatatgtaagtcctattaattgtgggatggaattagataggagtgtgaataccaggagccaatgtttactaggaaaatattgaatgttggttactacagagactatggtggatttgtatcatgccaaatgaactaaactggaattgcattccccagaattcccctccaagcatagttctttggtattagtccattttcacactgacgataaagacatacctgagactaggcaatttacaaaagaaagaagtttaacatggacctacagttccatgtggctggggaagcctcacaatcacggcagaaggagcaagtcatgtcttacatggatggctgcaggcaaagaaagagagcacttgtgcagggaaactcccccttgtaataccatcagatctcatgagacccacccaacaccatgggaaagacctgcccccgtgatccagttactttccaccaggtccctcacgtaacactcgggaattcaagataagatttgggtggggacacagccaaaccatatcatctttgttagtgagggccatgagagatattttgtatgagagttggaaggatgaaatgaaacagcatctatattctttttattttcagaaagtcagcactgggcacatggcactgttgtagctcacacaggtgtcatttatctgtgggatcacattgttggagtagggcagtagctgggccctcagaaatgccacagctgccagacacccactttcaatcactctgactttcagtgaggtatggtttagctcatagcagctcctcctgcagattaccccaactttaaagttggacacatggaagcagggttgcaactctgtcctgatagattcgggtttattcttgcaggtaccagtttgtctcgcttccctcattttacgtccattttatctttcagactgtgtgcgctgatgactttaggctcagcactagacacagaaacaatagtttcacaaagacttttcaacagtttccacaaatatataaggcaaatccctattacaaatcccttattatacacaaatctggtggtactgcttctcagatcagactctgacatagagactataaaataagtagctttaaattgaatgaagcaggaaagaggaaatcaattactataagagataaggtgacataaaaagcagatatatttgaaaagaggccaaatagaagttataaaatgaaaaatatattaaataagaaaaaccttctaatatatagatttatatatatataatatatataaatcctgaacaggatatgggtggctttgacaaaattccacataaacagtagttcagataagatagatgtttatttctctttcttttttttttttttttttgagacagagtctcgctcgtcgcccaggctggagtgcagtgatgcatcttggctcactgcaagctccgccttccgggttcacgccattctcctgcctcagcctccggagtagctgggactacaggtgcccgacaccacgcccagctaattttttgtacttttgttagagacggggtttcaccgtgttagccaggatggtctcgacctcctgacctcatgatccgcctgcctctgcctcccaaagtgctgggattacaggcgtgagccaccacgcccggcctatttctctttcataaattgtaagcatttcaggacttcgatgatagataagacatttccacattgtcaacaaaccagatcctttattgtaacttcctcaattagctttttaatcagagtccagcttggatgctccacatctgccatgtctgcacccccacagtgaaggtgttactaggttggtgcaaaagtaatcacggtttttgccactgagagtaatggcaaaaacagtgattacttttgcaccaacctaatagtttaggctgctgtcacaaactactataggctggtggcttaaacaacaaacagttgtttctcatagtgctggaggctaggaagttcaagataaaggtgctggcagattatgtgtctgttgaggctcacttcttggtttatagactaccaagatcttattttcatatgaagggaagagagctagctactctatggcctcttctcataagagcactaatcccatccatgagagcactaacagtattacttcatcgactctgaaaggtaccacctccaaacactatcacattgagatgagggattacggtttcaacatatgaatttagggggccacaaacatacattccattgtagtgggaaagaagaatgggaagacctactcttttccttttaaaactgtgatccaaatgttgtacatcaatttcacgtatataccatttaactgacccaaagtagctgcaaaaagtgctgaaaaatgttatatttaggtaaatggacacatattcagctaaaaatagcattactacacgaaatatatggatattgagaaagcaaataatagactccgacacgatgattaaaaagcagataattctcaacaggcaattaacagagagaaagagctgaggattttacagttactaaaagcaagtttaagagataaataagataatagattaaaatgggatagattcaatgaaagaataagagggaatgagatggtaatgatgattttttcaaaatcaatagcatgaacctaatatttgagaagcacactggatctgctgcaaaataagatgaaattacacacacacgcacagacacacacacacacatacacacacacacacacacacacacacacacagtgctaaaaccaaaaccaaacacccaagacataaagatcttcagaatcaacataaataacttatgaggaaaactactagcttctttataaaatctacatttcaatgcactgctgtggttgcagggaaataagtaaatctccaagcaccccttaaataaacaacctaataaacatgcaaaaaatgacctgaatcctgagatagaatcaaagaacagtgcgctacctgcaagacacaaatgggaaagttggagctagcctgagacaagtgttgaaattagcattgtgttccagagactaagcttgagggagctgatcctggaaacctggcattatgtcagcaagcctggtcccaggtcttactacatcaaactcctagcagagataatttcaaattctaccctggagaaaaagttgaccctaggatacctaaagattaagattaaagaaatcaagccatggtgagtgagacagcagaaacaacaaatagcaaacatctaattaagactcccaatggcttcagatatagaaattatcagaaattgaatgtaaaatgctatatatgaaatgtttaaataaataataggtgaaattacaaaatcagtaaacacgaaaatgtcaagaatgaacagacacagaattttacttctggccatgctgattaacagagacaggagctttcctaacattataaatatctggaaaacttggaaaatgtatgagtcaaattctttcagatataggagattaggcaatttaggattatggtccaagggaagtggaaacaaagtgagctctattaactgcctggaactactttccaacctgtggtgcagagggggtcactagcatgatctcactgagttgagtaaacagagatcagagttagggaagactgacttacctggaatattgaatgtgtaggacacattaccagtgagaaggaaagtaggtgaaggaggagctccaggaatatgcacaggggtctccttgagaatgttctaggtactaagttgtacatgcatgggaaaagtcaaagggctgggagctttaagctgaaggactcccagagctcaggtagggcggggaaatgtttacttctgaaccaaccagaatagattgaacatctacaacattcagtggaaacatgagaaggttcaggccttagtataagtgctaaagtagtcccgaggtaaagaattctctaagtccagcctaaaaagcttaaaagcaaacctctaaagaatcacactgatccacaattacatacttacttagccaaatgaaattgacatttgtaaaaggatggcaacaaaatccaaacactcaacaatatagctctcatagtttggggccaaatttaaaattactgtatatgagaagaagcaggaaaatgtgagccatgaccatgagaagaatcagtgaagagaaacagaaactgaaagaattggtggatttatatgagtagggcttcacaaaagctgttttaaatgtgttcaaaaattttaaaagaaacatgaataaaaatagatatggaaggtataaaaatgaagcaaatgcaaaatttagaattaagaagtaaaatacataaaataaaaaagtcctgatttttaatagtagccagacactgaagaagaaaatgtcaatgaactcacacatatgatatgaaactatccaaactgaaacacaaagaaaaataataaaaagccactgaacagtctcagtgatgtgtgaagcaatttcaagtggcacagacattacgtgattgatgatataaaaacgaagatgtaaaaatatttgcaaaaataattaccacaaatttgtcccattttgaattaaactatagacaactaagttttcaaaacttaacacacctttgccctcatataaagaaaaagataatcacagtgaggcacattataaccaaattgttgaaaaaatcagtgataaaagagaacaccttaaaaatagctaaagaaaaattacacattacttactcaggaaccaaaataagaatattggcacatttctcatctgaaatattacaatccagaaaacaatgaaagtatatggtttatatttatgtgggtaaatgcattgtttctcctcatttaaaaatatttagaaattgttaaaagcaaacagattataacaagtggaaataaagggaatgtcaacaataacaattgtaacaataaaaggatgaggaggccgggcgcggtggctcacgcctgtaatcccagcactttgggaggcccaggcgggtggatcacgaggtcaggagatcaagaccatcctggctagcatggtgaaaccccatctctactaaaaatacaaaaaactagctgggcgtggtggtgggcgcctgtagtcccagatacccgggagtctgaggcaggagaatggcatgaacccgggaggtggagctggcaggaaaaaaaaaaaaaaaaaaaaaaaaggatgagaggtaggaagtagaagcataaaattgtaagattcttatgttgtaagtaaatatatgatattagtgtgctattattcaaatacataatatggtaagtttgtaaacatgagaagaactacaattcacccttgaacaacttgacccccatgcagtcgaaaaatccacgtataacttttgactcccaaaaaacttaactgctattagccttctttagaccagaagccttatcaaaaacataaacaattgacgcatattttgtatgttacatgtattatattctgtgttattaacataaattaagctaaagaaaagaatatgttattaggaaaatcctaaggaagagcaaatacgtttacaatttattaagcagaagtggtccatcataaaagccttcatccttaccttatcagcttcaccttgagtaggctgaggaggaggaggaggaagggaggggttgttcttgctgttttggggtggcagaggtggaacagttggaggaggtagaaggagaagaaggagagaggctgatgcactcagtgtaacttttattgaaaaatatccatagacaattggacatgcacaattcaaacttgtgttgttcaatggtcaactgtgctacaaaatcaaaaagtggggcatagttactaagccaatagtagaaataaaaaaaattacttaaaaccacaatatcagttcaaaacaaggcaggaaaagtgaaaaaatcctaagtaaacagtaatatataacatgttaatagattgaaaaattcaatattgttaagataattttcttgcattaagctgcagaacaagcaaaataccaattaaaatctcagcaggacttttgtagaaattggcaagctgattataaaatttccatgtaatacaaacaattttaaatagcaagagtgattttaaaaattaagggcaacgttgaagaacttacactactagatttcaagacttatcatacactgcagtaatagatggagtggggtattggcataaggacacatatttagattaaaagaataacataatctggaaatgtttacaagcatatatagtcagttgttttttttaatcaaatttgccagtgtaatttaataggaaaagaatggtgctggaacaatagaatatcaacgtacaaccactgacagcgattataaccgtaaaatttaggtgttttgtggttgagggcatgatgggacatctacaaaataaaggacaaaatatttcttactgcactgcaataagatggaagtacaacatttggtagtcctttttggatacaggaggcagcatagttcacatctgaggatgctgtaccagaccatgtattaggtaatacaaatgtttgcattcattagtgcacactaactatggtagaagtgctgaagcactaaaaaacttagttggcaatgatttgtccagttgatagcaacccatgtttgtcggggttctctagatggacagaactaataggatagtgtctatatgaaggggaatttattaggagaaatgactcacaggatcacaaggtgaagtcccaccattggttgtcttcaagctgaggagccaggaagccagtccgagtcccaaaacctcaaaagtagggaagctgatagtgcagccttcagtctgtggtggaaggcccaagagcccctggcaaatcactggtgtgagtccaagaatccaaaagctgaagaacttggagtctgatgttcaagggcagaaagcatccagcatggaagaaagatggaggccagaaggcttagccagtctggtctttccacgtgtttctgtctgcttttattctggccatgctggcagctgattagattgtccccacccggattgattgtggatctggctttctcagtccacggactcaaatgttaatctcctttggcaataccctcacagacacacctaggaacgatgctttgcatccttcaatccaatcaagttgacactcaatattaaccatcacgcaacccaagtgtgagcatgaggtgcatgtagacatggtaaccatggtgatgtaaggaagactatgcataaattcagtagcatgggttccctgtctccaacacaaatttatctcctgttactgcatgatgtccatacatacaagacaatcactgagtccccctaatagcaccattctgcgtggagaccaattagctgctgggtggtgcgtagtggaacaatggcatgttaagttaaagatttcagtgggatgcctagctcagacatgagaccatacaaagatgggatgtcactttttaggatgtgtattctaaatcaacaaccataatatgattttttccgagtaggtaaaatacatgagtctaaaatcagggacttaaaatataaataacttacttaacatcatcaccagtttctcatttacagagtttgtgctttccagacccacaagtttggactgtatgatggagaagttctggtcgacaaaggtagaatacatcgactctgggacactgcaaaaatttcaatgaacttaagttatggcttcttccagtgtacttcaggggacttttcccaagtgacttgaagagaagtcactatcctgatagggataattgatctgaacttcggaaaaaggtagagctcttgtagaacgtaaagcaggaggaatatttttaacagtaactaatcttaatccactttggtgtcttttgatattctcttgtacaactttgagaatcaatgtaataatacagcagccaggacctgagaaggcatagcgactgtgactatagaactgtcacagatgaaggtctgagtcttccaaagttaggccacctgaccagcagaggtgctgtttaagggcgaagagggtgaaaatgcgtaactaagaagtatcttagctcaggcctctgtaaaaaatactgtgggtgggttagacaacaaaactttatttctcacagttctggaggatggaaagatcaaggttgaggtgctggcagtcagttcctagtgagggccctcttcctggttatcagatagctgccttcttgctgtgtcctcccatggtggggagagagtgagagctttggtctttcacttcttataaggagagcaattccaccatggggcccccacctctatgatcttatctaaacttaactatgccccaaaggctcgtcctctaaatgccatcacaggggaagttaggggttcaacatatgaattttgagggatatgacattcagtttacaacaaggatggtaatgttgaatatcagttacagcccaagatctactgcagagttggaagctgtgtggtttcttcatttaataagtctccactagagaaagaaaaaaatacacacatactagaatcatggagaagctgctcccaacatatatgtacacatggattcgagcagcatggattaactgaagtggacactgtgcttcactacccatttcctaagctgcttattatataaactgttggagtgctgctgcctaatagaactgccttcctggaagtccttcatcttttcatcttttactgaagcatctcacatccaatactggtggatacaggagtaaaaagttctggtccggttgcaataaatcagagaaatgctaaaaagttatcccagttccagaactctaaaagaagcttttgttgtgaatgaatcaaaatccaactttttttttttttttgagacggagtctcatcttgtagcccaggctgtagtgcagtggcatgatctcggctcactgcgaccttcgcctccggggttcaagtgattctcgtgcctgagcctcctgagtagttgggactacaggtgtgcaccaccacacccagataatttttgtatttttagtagagacagggtttcgccatgttggccagggtggtctctatcaaagtcaaacttctttgtctttcaattctgcttcctttcctttccttcctggtgttaattccaagaacactacccaatcaacctactgtgctatgttttacctatagtctgcttcccagggagcataacttgcaacattaaaaacttgagaacaaacatgtaaaagtgaaaaatcaacaaagcaacgaattctttgaaatgatgaatcaaagtaataaactcctaggaagactgatcaacaaacacagaaagcacaaatttaaaatatgcagaataaaagaggatatcactatagaccctaaagatgttaaaatataacaagaggatattataaacaatattatcccaataaaattttcaacttatataataagaatatatttcttgaagaacagaatttaccaaaacagacattagaataaacagaaccgtgaaaaactttgctaaaaattttgaaaagagaaaaataattaacaaatacatagataaatataacttaccaaaatttataaagaatggctttaagtaatcataaaataatttaaagaaaacaccaggctcaattcttgtatggtgaagtctgccaaaattaaaaaaaaaattaaattctatggacaaattcggaggataaaaaataaatataggtcagaaactcagatctacaaacagaaaggaagagcatttttaaaaagtgaagctaaaagaaagacttatttttcttattcttaagtgatctaagaaataatgattagttcaaaatattaatcacaataatgtactttattatgtatgtgtatatgtgcatgtgtgcacatatatataagtgaaatgaatgacagtgatgataaaagagatgagagagaggaattgggatatttaaaaattattattataaggtacttgcactaaccatgaagtagtatagtgttatttcaaagtggacttgtaaatgtatatttcaaactctagggcaacctccaacaaacacgaataaaagaagtaaaactaatgctaagaaaggagagaaatggaattatataaaatgttcagttaaaaccacagaagtcagtaaaaaagtggaagacattagactaaaaataaagggagagagaaagacatgctatgatctcactaataaaaaagcaggaatagctatattaattttagactgagcagacttcagaacaaacagaggtatgagaagtaaattagtacaaccattatggaaaacagtatgactagtctgttaaaaaaaaaaaaaaaaaacctaggccgggcgcggtggctcacacctgtaatcccagcactttgggtggccgaggcgggcggatcacgaggtcacgagattgagaccatcctggctaacacggtgaaacccctctctattaaaaatacaaaaaattagccaggcgtggtgatgggcacctgtagtcccagctacttgggaggctgaggcaggagaacggcgtgaacccaggaggcagagcttgcagtgagcggagttcatgccactgcactccagcctgggcgacagagtgagactccgtctcaaaaaaaaaaagaaaaaaaaacccccaaaaatgtaactagcatatgattcagcaatctcacttatgaatgtatatccaaaagaaatgaagtcagtatgtcaaagggttatctgcgctttcatgtttattgcaacattatttgctaagacatagattcaacctcaatgtccaccaatggatgaatggataaagaaagtgtggtacatatacacaatggaatactattcagccttataaaaaagaaaaaatatctgaaacaacatagatgagattgaaggaagttatgataaatgaaataagccagacacagaaagacaaatatggcatgatctcacttatacttggaatctaaaatagctgaaatcatggaagtagagactacaataataggtaccagaggctgggtgggtgacggggatagagaaaatgggaagattttaggcaaaaggtacaatgtttcagctaggaggaatgtgttgatatttattgcacagcagtgtgactatggtcaataatgtattttgtatttcgaaataactaagagagtatatttcaaatgtctcaccagaaaaatgatggataaagtaggtgatgtgtatattaattagcttgatttaattatttcacatggtacacacatatcaaaacatcacattgtaccctataaatgtacaattatgatttgtctgttaaaaataatattaacttaaaaggaggagcattgcatagtggtaaaggggttcattcttccagaagtcataacaacctgtaatgtatatgtgcctaaaaacaaagtatcaaagtatggaaggcaaaaactgatggaactgctaggtgcaattgatgaatccactgttttagttgaaggcctcatccttctatcacaaatggacacatccaacaagcagaaaataaatttaaggacacagttgaactcaatagcatcatcaatcaactgaatataattgacatctatagacctactttatccaacaacagcagaatacatttcttctcaagctcacatggtaccttaactaagatagaacacatgctgggccataaaacacaccttaagaaaaattttaaaaaagaatgatgaattgtctgctctcaagccacaatgtaattaaactagaaaacaataacagacagataactggaaaaatctcagaataacacatttcaagataacatataaataaaaaaaagttaagaaaaacaaaaaaagggaataaatgaaaatgaaaacactataacatttgtgagatatagtaaaatcaggtcttagaatttatagcattgaatacatattttagaaaagtgaggtggctcacacctgtaatgccagcactttgggaggccgaggcaggcagatctcttgaggtcaggagttccagaccagcctggtcaacatcgtgaaaccttgtctctactaaaaatacaaaaactagctgggcgtggtggcacgtgtctgtaatcccagctacccaggaggctaaggcaggagaattgcttgaacccaggaggcagagattgcagtgagtcgagatcgcaccactgcacttcagcctaggcgacagagcaagactccatcaaaaaagaaagaagaagaagaagaagaagaagaagaagaagaagaagaagaagaagaggaagaggaagaggaagaggaagaggaagaggaagaggaagaggaagaagaagaggaagaggaagaggaagaagaagaagaagaagaagaggaagaggaagaagaagaagaagaaggatctaaaatcaataatttaagcttctaccattggaaattagtaaaataagataaaatttaattcaaaataagcagaagaaaagaaataatgaaaactagagcaaaaaatcaataaatttgaaagtaagatatcaatgaatttgaaagtaagatatcaataaataaaatcaatgtaaccagaagctgattttttgcaaggtaaataaaatagataaaatagataaacctctaccaggccaactaaaaaaaaaggacaaaggacacaaatttttaatatcagagatggaagagggaatatcactacaactccattgacaacaaaaagatagtaaaggcatactatgaacaactgcatgcccataagtttgataacctagatgaaatgcatcaatttcttaagtaacaaaatctgccaaaactcacacaaaaaggaatacaaaatccaaatagccctatatccatgaaagaaatggactcaataattaataaccttccacaacagatagcatcaggcccaaagatgttcactggtgaattctaacaaagactgaaggaagaaattataccaattctctactatttatttcagaaaatagaagtagaaggagtacttctcaactctttctatgaggccaacatcatcctgatatcaaaaccagacagactttataagaaaagaaaactgcagattaatatctcttatgagtacagatgcaaaaaaaaaaaaacttcaacaaagtatttgcaaatttaatccaacaatatataaaaagatttatacatcagaaccaagtgggatttatctcagatatgcaatgctggttcaatatcaaaaatcaattaatgcaatccattgcatcaagaggcttaaaaagtcgtgaaattgtatcaatagatgcggaaaaggtatttgagaaaatccaacactgacatatgacaaaaactctcagtaaactgggaagagaagaaatcttcctcaaattgaaatggaatatctacgaaaagcctacagcttaacatcatctttaatgatgaggacctggaagctgtcccaccaaaatagaaagaggcaagaatatttcctgtcactactgcttttcaccattgtactcaaagtcctagttaatgacataaaacagaaaaagaaataaaaggtatacagattggaaaggaaaaaataaaactttgttcacagatgacgtaatcatttatgtagaaaagcctaaagaattgaccaaaaaaccctcctagagctaataagcaattatagcaaggttgtgggacaaaaggttaaaatacaaaagtcaatcactttcctatataccagcaataaaaatttgaatttgaaattaaaaacacaatatcatttatattagaacctacaaaaataaaaacttaggtgtaaatccaagaaaatatatacaagacctgtacaaggaatactacaaagctatgatgaaaggaatccaagaactagagtgacaatccacgtccatggacaggaaaactcaatattgccaagatgtcagttcttccaaacttgatctgtaaattcaatgcaatcctcatcaaaatctcactagtcattttgtagatattgacaaactgattctaaaatttatatgcaaaaggaaaagaaccagaatagccacgacaatattgaaagactagaacaaaattggaggattggtagtattgacatcaagacttactttaaatctacagtaattgaggtagcctaatatttgcaaaaggataaacagatcagaggaacagaagagagcatgcagaaataaagctacatgaatgtactcaactaatcttaaacaaaggatcaaaaacatactatggagaagatagtcccttcaacaaatggtgctggaatacctggatatgtacatgcaaaacactaaatctaaatgctaaccttatacccatcacaaaaatcgattcaaaaaggttcaaaaacctaagtgtaaatgcaaagctataaaactcctaaaagaaaacataggagacattgcagatgagcctggatttgctgataactttttatatataacagcaagggcataattcatgaaagaaagaattggcaagctgaacttaatgaaaattaaaaatgtccactctgtaaaagatattgttaagataatgaaaagacaaatcatagactgaaaatattcgcaaaagacatatgtcatgaaggattgttattcaacatatacgaagaactcttaaaacataacaataagaaaacaatttttaaaatgggcaaaagacctgacaccttagcaaatatgatacacaaatagcaataagcatatgaaaatatgctccacatcctatatcatgagggaaatgcaaattaaaataaagaaattccactaaatgtctattacagtaaccaaaatccagaacattgacaagcaccaaatgctgatgaagatgtggagcaacaggtaccttcattcattctggggggaatgcaaaatggtatagccactttgaatgacagtttagcagtttcttacaaaactaaacatactcttatcctacaattcagcagttatgctccttaatattaacccaaaggagctataaacatgtccaagcaaaaatctgcatatggatgtttaaagcagcttcatttattattgccaaaacatggaagcaaccaagttgtctttcagtaggtaaatgaataagtaaactgtggtatatccagacaatataatattatttattgctaaaaagaaatgagctctcaatccacgaaaagacatggaagaaacgtaaatgcatactactaaaaaaaaagccaatttgaaaaggtacatactgtatcatttcaactatatgacactctggaaatggcaaaagtattgagacagtcaaacagtacagtggtttctaggtgttgaggggagggatggatgaataggtgaaatacagagcaaattcagggcagtgaaaatcttctgtctgatactataaagatggacacatgtcattacaaatttgtacaaacctatggaatgtataacaccaacagtgaacaataatgtaaattttggactctgggtgataataatgtgtctgtgtaggttcatcagtcataagaaatgtaccacattggtgggggatgttgataatgagaaacgctatgcatgtgtggagacaggaggtaggtacattgatgctgtgacccttcctctcacttttgctgtgaatataaaactgttctaaaaaaaatactttaaaaaatccatggtgaagaaaattataaagacaggctattgtttcttgtttgttttacaaccctgtgctttgtgcaagagaaaaagttgttcccaatgagccctaggtcctagtcagggccacaaaactgtcacatcccccatggggtgggccaataaaggctgacaatagtgttggaacaagtgaggcaatgcaggcctttatgtatactcatggtttttgatttttattaacttttattacctttttcgatttggttcaacaaatgaaatttacagatattttacataagtgtatattgcagagcccatttcttcttttgcatcaggctcagacatggcttgtcatggcactgaggaagagatttattcttcttgactctggggtttcctagtcctttctatctccatgatgatggcccaaatgaactgaacttccctagcactgtctctgcacaataacctcatgggtcttcattccctaatctgacttttaaaggcctgctgagtaaagaaataagatcctagggaattctgaagtaggcgaagatgtttctgtagtacttcaatttccaactttacatcattttcctttcaaagtatgcccccattttcactcactaacattcatagtattttacctttttatcatctcaaaacatttgagaaatttgtggaataaattaactcattctgaggtaaaaaaaatttaaatcagctgagtgggctctacacactgcacagaaatagtgtctgttttacaaaaattaaaattttgctagctaaaataaaacactagctgttaaatgtcaagtattaactcatgggtgaagaagtgaaacctttcaatagccctttaaaattttaacaattacttcttaaactacgcataaaaaccagttttaatatatatataacacaaaaaaaacacagaacaactttttcaaaaaggtcaacagttttagttacaaaacaatgtctctggatgtggacattaaaaagactacttccaagaaaattaaatttttgaagtcttaattaaatccaaaataggcaatgtgtgccaacactacaaaagacatcaaaagtctcatctgccaaatgttgcccaatttgagtacagatttcatttcctatgtgaatgccatgtcctattccctgaaacctgaatgactaacattgaaaaatataagaaacataaagtgataggtattatgtgcagattttattaatagcacaacaaataatctttagtgaacaaaatggacagtttccatgactgaatctcaagaattagaattagaatgactggatttataatttagatacactggctttttacttggtgacttatttaggtagttacaataattgatattttctaagcacttaacatgttccaggcatgataataggctgctaatatagtttatttgtttacttttcacaagagtcctatttaatctcctttcgcatatttttcatatgagaaaactaagtatattctaagattatggaacttgcccaagtttacacagggatgtggttcaggacgtgctatccaaaatacagcaccttgacacaatgagtattttaagctgaaggaattgatcaaaccacagaaacaggaagatgtctctgaagcaggatatagaaacagttaataaaagtaattcaccttgaccttgtctcctgaagcagaccataaaacctagctgagcttcccctgaaaataggtcataagactcttatttcaggggatttttgaaatatacccagaagaaaggaatgtcacacaggaacaccaagaaaaatctgaaggggagaaaatataaatattttttctgagtcctcacaaggtctttgctaggatacctgtgtaaaaaaaaaaaaaaaaaaagacaaatgaacaggaacaaaaaggtatacaaattttactaacatgtatatagatataggagccatgcactgagtatgagactcaaaggaagtgccagatagctgaagtttttgtaccatcttgaggttacagaaggaataggggaaagataggatatgggagggagagaggaggaaaggcatggtgagcaaaagcagacttgttattgcagaaatctcacagatagcaactctcagaaagaatacatggtggcctgcagtaacatttttctgtcaaaacttctttgaaggtataagattttagtctctttttctgtgagttaatctttcctggatccggataagaggaccctcagaaaaagtctgtttgcgttgctgtatttttttactaatgcagattttctctataatgcaaatctcccacacaaaagggcaattttttcaggggtatttctgtgggttgcagcccttcagaatagccatatagaaatacaccaaaaaagtatattttgtggtgaaatattctggtttctgtcagaacaaacaggtcttgctaaattttctcccagtttatagctattagatcatatcttcctttttcccaatcatgttcctccacaactgtctacttcttcatcatgcttagcataaaatatacacagttttccctgtttctttgggaaacacagttttcccctccgaatatacacagttttcacctctgaaatttccatattacgtaaaatttatattaaatacgttgtatggttttctcttgtaatctgtcttttgttacaggagtcacagtcatgaacctagcgatgggcgaggaaaagaaatagctttttctcctctacagtttcacagatagcacatgcagaaaagccggtgagacacacatattcagctggagaaaagacttgacacatcactttttatttatttattttgagaaaggatctcactctgtcacccaggttgaagtgcagtggcacaatctcgtctctggtagagacagggtttcaccatgttgtctaggctgatctcgaactactgagtccattggatccacccaccttggcctcccaaggttctgagattacaggcatgagcaactgtgtccagctcataccacattcttaacatatgctactacattctttactcaccagcttatagttcactactatttttcctctccctttctcatttgttaatttattaattttccatgacttgggaggcaaaacttttatgtaacataatagcaatctgtatccctttaaaaacattggctgtttttacacgccatgtaaacctcagtaaaatgagtaccttagagaattatatagattcctcagcaattccaagagatccaatatcctttccctgttgcagaccagaactttatcaggctacttaggtatgaagtaaaactaccagttcctgttttccattaagcagagcaaacaataggcaacaaacaaacaaacaaacaaacaaaccagaattcaagcttgttgaagcaacaatagcaacggaacaaataataatatgaaatttcaatacagaattctgtcaaagtttttccttctactgttcacaaaaatgttcaccaaaacatcaggcttactgacataggacaaactgcataatgcaatatgttaaataacaagcattgtccattataatgaaaggaaacaagagtcaaaggcacgatattcataaaacacttggaatctataacccactaaaattcaggctaccagccaaatattataacatcttcaaacatcaggtaacttaaggtgtatgatttgaaactgataacacataatttccaaagagctctgtataggtaaacagtggtgatgcagtgagctatttgtgtcgagtatttatttctttgctgtctaattgctccaactccctagacgttaggagtctatcacctgctgttcctcagctgctaagatcagagaatataacacagatggagtgagctatgttctcacggctgctgcttcacagagataaggctgcaggttggagaagtgctcagctctgccttcctctgaaagagcctgaacagctatcaataattcccagttactcctctaccgttatgttaaacaacactgccttgcatacacaggtgcaattagataaaagagagttgtttaaatcacttgaaatgcctgtagctttattattgcagatctttgtgttgtctctcgtcttttctttttttaaaaaacctctttttcctgcccactccctcccccaggtctactgccaaactgcaatgatttaagaacctggttaaaatattgggtcacatttcttcaccagttgccttgagcgtgtttggggagctattctttagccacccttgtcattctgctgtcattcacagcattatatttctaggtatgagaacattgcaaaaatcagttatgctcattcaggaacatgtattatgtctggatatgatctcacaattaaaataaaccaatttccagcagccagggtatggtagctgcaatcccttgtatcactgaaatttatacagttcttaattttatcaaaggacaaagatcattttacctccaactcctaaatatgcaaatacaaactctccacaccctctcctgacactggagagtggtagaaagggtcggactgtgctactaaatcgggcttcatataattcaccattttgatcagttatcataattgacatcagcttttgcttcctgtgaagcaacacatggaatgcacttagtacagggcctcctagcctattttcaaatatcaactactgctgattaccaatgtattttcggccctttccctcctgatatgtccttgagtatcaagttcagtggctgttttcccccactcagcctagatactctgggattctttgaaaataagctgatatgactttcattagtgtctccacactttaaaaatttatcacgaacactggtacaagtgttctttattatatagaaacaatgataagggattcattgtcacaagatttttaagcagtgaactgattaaatactcattgcttgggttaattttacatatttaaaatgctttttttttttttttttgagacagagtctcactctgtcgccaggctggagtgcagtggcacaatctctgctcactgcaacctcctcctcccgggttcaagagattcttctaccccagcctcccgagtagctggaagtacaggtgtgtgcccccacgcccggctaattttttttttttttgtacttttagtagatttgggttttcaccatgttggccagaatggtctcgatctcttgacctcgtgatctgcctgcctcagcctcccaaagtgctgggattacaggcgtgagccaatgcacccagccaatgcatatgttttttaataagtgtttctcatacttttccttaatctcctttatcgtactagcatcttattatttactgttgatacaacattctgatttcccctctaagcccaaggtaagctgcttcttactaaaaaccaatcattttagaaacaattaaacatgaccaagcaaagactgagctttatggtcacactctgttatgtaaatgaggtaatttaaaacaaacttagtgtttttttcttttatatttaagcttatattgttttacctagatgtttaagcaactctgccaaatgtacagttcacactgtatcataaatactattacaaatttattaaaattattttctgacatttatgtagtatatatgcatatatattttaaactttagtttaattaaaaggtgttaaataattagtaaaccttagaagtaaattattttccggattaatgaatttctaattttatataaaattcaattggaaaatagcactacagtattctcttagcagaccacatcttctgtttgctacctaagagataatctacaacctcaagtctctatggttgtgtacaattcatctgagctcatcaggcttactggagagtcaggtttccctctgtgatgcaatatttcatagactaagcatctttaccatttcccccggatgttcatggtttcacaccttggaatagtagaggccaccaggctcctctagcccatagtgtgtttccacattgacatcctcccagtggataccccagtcaacaaacaccagcagcaccggttatggcagcagtttattttagtctcctcgatgacccagaatttcttctttccttcagtaactggtacttctaggaaaaatacctctgagaaaacctccttatctcttatgatctcttggtagctacacaactcattattactttcttgactccatgttaaaaattcatgttaggcatgattttacaagcatttggtgtcctgtacaatgtcattaaagaaggagtatctgtaaggggaaacgtgagatattttctgtgaagttggaagacacggtactcaagaccatcctcactttgaataccagttgtatgtttgggggtttcccaagatcactctcagatttaacaagtcactagaaagacccagggaactcactgaaagccgtgatatattcatggttatggtttattacagagaaagaatatagaataaaatctgccaagggaagagatgcacagggtggagttcaatgaagtgggggtgtgggtgtttcaaatgtgaggcttctattattttcaggatgcattaccctcctgacatcaatgtgtgacaatatgcatagaatattgccaaccgaggaggctcctcagaactttagtttccagagattttactggaactctatgtttgactgcccacatggctgacctctagtctatggactgttggaggctgaatggataccatgtggcccaaagacgtcatcataattcacatgaacagcagcactatttcaatttatgacatgtaatatgtatggatcagtggagcttgtggttttcattgttctgtgtgtgtgagggtgatgatagaaaccatgaattattttgcctaatgacagtattttaatgcatatcttttgaatttagcaggccagtagattttttgttgattctcagatcagctgaggtctccctagcacctccgatttgagtttcagaatcctatatagataatattctagggaagtccattgactcagattttattggtttatagaaacatgattgtattgtatttatttggatttgaatataagtaaaatattttccatggtaactctttttttctaggaatatgtgatatctctctaattattcaggtcttgttttacatttttaagtagagatttattactttcttcataacagtcttgcagattaatgttgtttaacccttcttttatttgtattgtgggaaagatacttgtattcgtctgttttcctgctgctaataaaggcaaacctgaaactgggtaatttatacaggaaagaggtttaattgacccacagttccacgtggctaggaagcctcacgatcatggcagaaagcaaaggggaagcaagacatgtcttacatggcagcaagcaagagagcgtgtgcagggaaactgcccttttataaaatcatcacatctcatgagacttattcactatcatgacaacagcacgggaaaaacctgcccccatgaatcaattaactcccactgggtcccttccacaatatgcgggaattatgggaattacaattcaagatgagatttgggtgaggacacaacaaaaccatatcaacacttttacattacttttaaaaaatctgtttatttctgatattatagaactacagtatagagcagggatatggcataaggtataatatatcttgtcttgaatgttactgtattctctcataaatttgaatataatgttaatgtacctatatttctatgtattattaataataaaagctatcattattaacattccactactaagatgactaaattcttcaattttctactatatttcttaaaataataatataaataatagttgttcaattgggcatcatttctttgttctctgttaataaggggttttctattgattcatgatattcttcaatagggtaaatatcttgtgtcctattcttagtttgtcacatgattgttttttaaaaattaaaaatgcatactgatttcaaattattttttcatatcttaaaatatatttgtagttttcttttttaatctaataatatgtatttttattatttcctactttctcataacatttaagacttaatttttgtagaaaaattttagctgcattgtgtaatatttttatatgttgtattctcagttttgttcaattctagtttattacatactttgatttcctgtttatttgaataaatatttggaaatgtaaaacatttgatctttattccatttcttccttccctcctttcttcttttcttctcctttcaattttctaataccactttccaaaactgaacaatttgtgctaaatatttttgtgtttggctttataatgttgttggatttttaaaatccaaaacattgttatactggcaaacactatggtttgcttagttaataggtgttctccaattttgcataccaacaaaactccttgttttgactccaaagttcccagttgcagaggattcattatcattggttttggtcatagaaaccaatcttattctccttgataaatccttgctttcatgactgtcctggctgctagagctgggcatgtgacctagttctgtccaatgagttgtaactggagatatcctgaggaagcaattggaaaaagaatatcctcttagataataaggggataacagatggagatagctcctgcttcttctgcctcctgcccttgaataaaacctaactctgcagtggctgaagctgtgacaatcctttggtctcccagggaaaaacaagaaaattataatagaaacagcttaacgtctatatatgtaccaacttttcttgatgttagttgcagtcaggtcattaagttctgacgaaagatatgcaacttttgatatttttcctctttctagtttatcctgttgcatacagctctagctaaagcaattttttttaccttaaggtgaattgaaaatggaattccaaataaaaatgatgtaacaacaaaagaaaatgttagatatccaattctgtagggcatctttcagccatggttcatgtatctgaacttttacacagtaaataattaaatttccatatttttagccagtttttattttgaattttctgtcccttaaatccaaaactaatcttaactaatactggtgttgactcagaatcctgatttttgtgagatgagtaaggaaaagcgtgactgcttaactttaggttcttgttaagtgaaatattttcttacttcatggttggtttttctgttgcttataggaaaagtgttcactataaaaaataaagacttcacagatatagccatagatttgataattatccttatttgttatattaatttctctacgtgaggagaaaaggaactgccaataacctacagaattgatacttctggggtacattttgaagcatcatatttgaaaacaaacctactgacctctgttgctgattttcataggcagagcttttaaagaaagtaatctcccttataatatagcatttacatttccatatttcatagctataatatagttttatagcatgatagtacaatttctatttaatttgatacctgacttaatatatgtgtatgtgtatttatctatgtgtttaaattctaatattcaaaattgttccaaaaacacaattctgccctttgtgatatgataaagcccagatagaaagctcttaatttttgtcattcaaacatctacactttaatgcttaaataaaagctgtcatccaaatataaagcattctctggagatattacatattttaaagatcatggctagtggactgagtttagtaaattaatacgtaaaaagttaattctaagttaatttcataaagaatgtccaggggacaataagtagcttgaagaagacattgttcagaaaagtagaaagttgttgctttttccagctggttgatatttcagggtcattttgtattttaaaattgccagtctttctaccacttgaatatcttggagctgtgtatatgaacatagtcaactctttcattgccttgagcattgctggaggatattcaagctatttgctgatctctagctatgttttaaccaaactttattttataaagagtccctaggtgcaactatgaggcatttttatgcctcctttgattgattcttccagccatagccctcggtgatttggtaatactttaaatccttgcctaagttgtttcactattagataaccagtgtgtagacctgccagaatatttgtattcctttctctgtggccaagaactgacttaatgttccctgagagaatttcattgtttgatggccctcctcattctgttttctacggtctgtggttttacacaaaacttattatctttgaagttaggcctcatcttcttatccttctaatcctatcacctccagttttttttttcttagagatggaattaaaaggcagtcatacctgattttgaaactaagccccactagtgtttgactaaggctaagaaactgacctctttaccacaagttccataaactgcacattgtaaaaaataaagttgtgatgtaatagtgccagtcacatggtaactacttaataaacttcagtttatctctttcccttttactcatattgcaattataatttgttcttttgtattgaagaactaatggactttttaataataaatatagtcttcagtcaacatttattgcatatgtataatcagatttaatcaataattttttttattgtttttgttcttgagttaactggttgctaatttgtaactcagaacttttctgattaataggacaactatgcattttttaaataagaaatacatggttgaaatagagcaataccaatttgttactacatttggatgagtgtgcacatttttgaatttattgaataatagtaatttttatgattaaaccattcattagtactttagaatatattaacctggagttttcaaatttatattcaaggcgattgtatgttaaaatgcaaatattttatattcaggttttgtaaaaaatattgttttgcctctcttaagctttaaacattgatttaaataaggtctaagtaatcaatttattaagtgatcaatctttgtattcaacatgacttttatgttcccaaaactatcttaatctcacctagaattttatacttacacttcaggattcttagttccatagcaatattgttctagttttacatacaggagaattttgcttttaacttgtggtgtaaaaccatgatattttcttagcagttaaccatgtttgtttgttattttagctactgtaaattggatttatgcctgggatttagtaagcccaggacatagaaactgtgtgtgtgtgtgtgtgtgtgtgtgtttgtgtgtgtatatacatatacatatatatatatactatatatatatatatatagagagagagagagagagagagagtttttttttttttttttttgagatggagtctcgctctgtcacccagggtggagtgcaatggcgtgatcttggctcaccacaacctctgcctcctcggttcaagtgattctcctgcctcagcctcccgagtagctgagattataggtgcccgccaccacacccagctaattttttatatttttagtaaagatggggtttcaccatgttggccactctggtcttgaactcctgacctcaggtgatccacccgcctcggcctcccaaagtgttgagattactgtgtgagccaccatgcctggctgaaactgtctatttttctgagaaattccaatatcatgggcatcccaatatttttagaaaaattaaaagcttttattcctaaataagcttatagaaataaaaaaattgcaattttttaaaaaaattcaaaacatttttcattaatcattttacaaagatactactgggagaattagtccattaaaaataatgggtgatatcttcttcttccacttagaacatagagttgcaagaggattgtctcttcaatcctaaccacgcgaaacttaaagtcatagtttcttaagctcattagagatgggagcatgcaaagaaacctactaaattataacccacacagtgatttgcttagaatagaagtgatccacaaatgctttaatctgtggccaaacagctgaataatgaagaagccaccaaagctatgagcaagaagaaaacagttatactttcaatgagttgttaaagactaataacagactggtatgacagaatccctaggagacatagatgaaaaatatctgcaactatccgccaactctttcccacaagccttattgagctctcatgagaaagattgtgggcagcacaggagagctgagacagattccatgggaggttcaggtgtgtagggcctgctgaagtctgaggggaagaagtaggactgagagaaacctctggacacttcagatactcatcatgtggtaatgtgatgagcctgctaaaatgtgagggcagagcagtataactgcgagaaagcccttaggccatggtgccttatacttaatagggaaaagcacctctctgtgcctagagaacaggtgagaatgacttctaaaggtgcaaaggtacagagattactgaggtctgaggacaatgagaaaaaaaaaatggagggcatccctatatgcactctgggtctgacaataagcatgcagcagatgccatttgtagctgggtgtggggaaagaaagatgaaataaaactatcccaagtgcatgagcatgagatctgatgacatgaaaataaatggctcagacactcagatcccaagtttattaaaataaaggttctaaaactaccctcaaataatttgaaacctgtagggaactaaatctaactgaagcaacaacagagtttagacctaggtcaactataggctaggttgactcagaaggagcatgcccttttatagccaaaaatatttacgtcagcatctattttttttcacaaattgtccagaacgtaagcaaaatttattagacaaatgaagaggaaagaaaatgcttcaggagagaagcagtcaagagatgtgagaattatcaaacagggacttaaaaataactgtaataaaaatgttaaacggtcttaaggataggccagctattttaaagtaactatgtgaaatatgttaaatgaccttgggcaaaaagcagatgacaacaagcaggaacagatgggaactactagcacagcatatattataaagaataaggtcaacggaaaatgctagaaattaaaaatatggcaacagaaatgaataattattctgatcagctagcttattggaagactgcacagcagaggaaagaatcagtgagtcagtgaccaacaggcaagtaagtagaaactgttcaaattgaaacaccaaaagtaaaagagtgtattactccattctgtcattgctataaagaactacttgagactgggtaatttataaagaaaagagtcttaattgaattaaagttccacagactgtacaggaagcatggctagggaggcctcaggagacttacaatcatggcagaaggtgaaggaggagctggcacatcctacatggatggagcagaaggaagagtgagcagtgggagttgatacacacttttaaacaaccagctctcatgagaactcactcactaccatgagaacagcacaggagaaatccatccccataatccaatcacttcccaccaggctcctcatccaacactggggatcacaattctacatgagatttgagtggggacacaaatccaaaccatatcaaagagtaaataaaagaaaatggagcttgcaagattaaagggatgctataaaatacaaatattgaatataaaattaaatcataatatgaaacatagtcattgaagctcaagaagttgaagtaaaattgcacagaagaaactatttaaagatagaatagcaaatgttttttcaaaattggtattacatcaattcacaggttaagcacaatgtgtatgctgaaactgtacgtggacatatcatggtggaactgctgaaaaacaaaggaaaagaggaaacagtaaaaactggtggaggaaaaaagacattacattctttaaggtggaataacattgagacaattgctgatttcttaccagaaatgattgaaaccaaaaaaaattagaatgaaatatttatactgttggaaaaaaattatgcataaaaatttctatattcaaagaaataatcttgtaaaataaaggtaaaataaaggtatgtttaaataaaagctcaaagaatttgcagcaatgcatttcaagaaagactaaaataagttcttcaggctatagaaagtgaatatctataaatctaatacacataaacctagaacatcagaaagatgtaaatatatagaacatatttacaaaaaattttgaaatatctacatctatgttcataactttatatcaatatttgtatctatctctttaaatgtctttaagatactatggactgtttaaagcaatataacaatgaactgtgatatcctgtaacatttgtgtaattaaatatatgatgagaacacaaaaatcaggaaggtaataattcaaattatatttttgtaaaattcttattgtttataaagtagtacattattttagaagctagattgttatagattaaagatacataagagaaacgacaaaataaataacacaaagaaacacgactaaaaatgaaaagaagagataaaatggaatactaaaaatatcaattcactctagagatgaaaaacaaataccattttagtagacttaaactcaaacatagtaattattacattaaaagtaaatgtcatttggttcttctagaaagtttactcacacagagtagaagttcaagatattttctcacggtaacacctgtgaataacaaacacgagggtcattaggaatagcaggaaagcatttctattgccaatgtattaatactggtaaaactagaaagagaaggaaaacagattgcataaaaagagctttagattgtaaagtatctttttcatcaacttgtagtaaggatatatgctaacagcgtgacttattgttgatgatattaactttgattacctgaccaaagtagtgttgaacagctttttcaactgtaaaggcattctcctctcttccacactgtagtttttgaaagcaagtcactatttgctacaacccacactcaagagacagtgtcttagtctatttgggctactataacaaaatatcatgaactgagtggcttaaaaataacagaaatttattccttacagttgtggagtcttggaactcttaagttcaaggtattggcagatttaatgtctggttagggtccactttctgtttcatagagggcgccttcttgctgtgttcttagatgatagaatggggtgaggcagctatctcactgcaacctccacctccgggttcaagcgattcttctacctcaacctcctgagtagctgggattacaggcatctgccaccacatctggctagtattttgtatttttagtagagatgtggcttcaccatgttaggcaggtttgtcttgaactcctgacctcacatgatccatccacctcagcctcccaaagtgctgggattacagggtgagtcactgcgcccggcctagcaaaatttcaagtatacaatacagtattgtgttaactctagtctccatgctgtacaccagatcttcagaacttattcatcttataactgaaagtttgtgcacgttcatcaacatgcatccatttcccctaaccgccaggccattgtccattagcaaccagtattctactctcagtttccatgagttggatttttatgaattccacatatcagtgagattgcacagtatttatctttctgtgtctggctttttcacttagcataatccatccagatttattcatgttgttgcaaaagacagtatttcttcttttttatggctgattagtattccattgtgtatatgtactacattttctttatttattcatctgttgatagcattcaagttgttttcataccttggctattataaataatgctgcaatgagcaagagagtgcagatatttctttgagctaatgattttatttacttcgaatatatacccagaaatgatcgttctatttttaattttttgaggattctgcaaactgttctttgtagtagttgtaccaattcacattcccatcagcagtgtactggggttctctttctccacatcctcaccaagagtcgttatttctcatctttttgagagtagctgtactctaggctcatcttgtgtattccctgctcatctttggattaggccatttctccaaggaatcttgatttattttattggagaacagttttagaaacaaagacctggtagttgagtgtgtcagttttactgtagtgttgctacttctaggtcttcaactgatagaactagagaatatatatatgtgtactaactcatgtttacacaaatatatataatcatttacctacttatatatttgtatctgtattacgctagacataagttcacacagctgtccctaactctaatccattaccacgtggttcattctagtttcccctgtccttgcctatctgaaactgctctcccaatagaaataaacctgcctcacagcatccaccatgtatttacatattcgttcgaccctactctacatatacagctttttcagaattgttaacccaggtggctgtgaaaaacaactatagtgtttatgtacagttccttttgtttctagtcttagagtttccaatcaaagcaccgttttccaaaattacttgtcagctagttttctgcccacccttttcagtgaggattttccataaatttgtgatacagctagaatcttttcgtcactatgttcattgcatacaatacagtcttctggttaattcctttaatttgtataaattaaggtttactcattttgttgtacatcttttttttgttgttgttgttgttttgcgatggagtcttgctctgtcatccaggctgaagtgcaatggcgtggtcttggctcactgcaacctccacctcccaggttcaagcaattctcctgcctcagcctgtggagtagctgggattacagcggtctgccatcatgcctggctaatttttgtatttttagtagatatggggtttcaccatgttggccacactggtctcaaactgctgatctcgtgatccgcccgcctcggtccccagagtgctgggattacaggtgtgagccactgcgcccggcctttttgtggtacatctttatgggtttcaacaaacgcatagcattttatatccaccactacactacaatatggattaattccattgaactgaaacatcttagtgcctctcctagtcaaatactctcccttccacaatcatttgaatatcctgatctgtctttcagtccaacagttttcccttctccaaaatgtcatacgaatggacttcaacatagactttcagcctgacttcttatgtatagcaacatccacttaaagttcatctaagtagctccatgagttaatagcttatttatttttattactgagtaatattccattatatggatgtaccactgtttattgatccattaatccaactacaggatattatttcaacattgcttgaaatttttggtgattatgaataaaactgctaaaaacattcatctgcatgtatttcttagacatatattttcaaatcaattgtgtaaatattcaggaacacgcttgctaccttgtatgataaatctaagttatatttagtaagatactgccaaactacattgcaaagtgcctttttgtatccccagcagcgatgaatgagaggtcctgctgctctgagtccttgccaggtttgggaattgtcagtgaagagtctatttagatcttttgccttgttattaattaagtacaagctctttatcagatatattatttgtaaatattttctcccagtttatgacttgtcttttcattcttgcaactgcatccttcacagagcaaaatattttaaaattttatttaaagtttaatttttcattatgttctttcatgagttatactgttaatgctgtactttaaaacacacagtcaagccctaggtaatgtagattgttgtcctatgttttcttctagatgcagaatttctttttcactctttttgctgtaagtttttatgtgttttgaccctatttgtgtaagtatatttttggaatctctattgtgttccagtgatcggtatttctatctttttgttaatagcaaacagttgtaattactgaagcttaataacatgctttaaaatcaggtaataggagtcttgcaaattttttttttgaaaaattgttctgattattttagtagctttacctttccacataaatattgaaccatcttatgaacagaacatctacaaaaagcttgctgagatttttatttatttatttatttttgagatagagtctagctctgtcacccacgctggagtgcagtgatgcgatctcggctcactgcaacctccgcctcccaggttcaagtgattctcctgcctcagcctcctgagtagctgggattacaggcacccaccaccatgcccagctgatttttatatttttagtagagatggggtttcattgtgtcggccagactgatctggaactcctgacctcacgatccgcccacctcagcctctcatcttgctgggatttttattgagattctgttaaattaatagatggaattgggaaaaattaacatctaaacattatggaatgttcaattctttctttttttcattgctgaatataaaaaaaaaatttaaacttaaaaaatactaattatagtagcataaacattgaagcacatagacataaatatagcaaaatatgttaacataagttttaaggaacagaaatcaacagagtatgttctctgaccatgtgggaattaaaatagaaatcaataacagaaagataattttgacaaacaccaaatttgtgaaaattactcaacatactctaaattgccatgagtcaaaaaaaaaaaaaaaaagaaatcagtattaggaaatacttagaaatgaatattagtaacaacatgaattttcaaaatgtgtgagatgaagctaaagtgtatactacaaggtaatttagtaactatgtttacaaatcaaaaatacatggaatttataatatatgtctcaaatttataaagttagaaaaaagaaactaaagataacagtggaagtcattaaaaatgaaaatgaacaaaaagtaaagaatgtcaacaaagtaaaaaggcaatacttgaaaagactagtaaaatttgtaatcctctggaaagagaaaagctacaaattaccaaaataagaaatgaaataatggatgtcatttctcagtactacattactaagaaaatgcaacaaataattcggtgtgaataagtttgacaacgtgaatggagtagaaaaaaattgttttgaattttttgaaagacgtaattggcacaagacatagaaaaatctcaacagtattattaatatttaaaaaaataaaattttaatgatggaatcttcttgcaaagataactctaggactgttttgcttcactagtggattctaggcatttaagaaaatgacaatatactaattatattagaaaacagaagaaaaagaagtatttaaaacttattttattaggcaagtatgtctttgattccaaaaccagacaaggatactcaaacagagaagtattgcagacaaatacctctcatgaataagaggcaaatatttcttttaaaaatatcagcaaattgaatgctacatataaaacatattacaagaaaatatggtttaccgcacctggctcggagggtcctacgcccacggagtctccctgattgctagcacagcagtctgagatcaaactgcaaggcggcagccaggctgggggaggggcgcccgccattgcccaggcttgattaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagggagcagtggttctcccagcacgcagctggagatctgagaacgggcagactgcctcctcaagtggttccctgacacctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacctatctgtacatcaccatcatcaaagaccaaaagtagataaaaccacaaagatggggaaaaaacagaacagaaaaactggaaactctaaaacgcagagtgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctgaggagccgatgtgatcaactggaagaaagggtatcagcaatggaagatgaaatgaatgaaatgaagcgagaagggaagcttagagaaaaaaagtataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagatttaggaaatacagagaacgccacaaagatactcctcgagaagagcaactccaagacacataattgtcagattcaccaaagttgaaatgaaggaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggcctgccctaaaagagctcctgaaggaaacgctaagcatggaaaggaacaaacggtaccagccgctgcaaaatcatgccaaaatgtaaagaccatcaagaacaggaagaaactgcatcaactaacgagcaaaataaccagctaacatcataatgacaggatcatattcacacataacaatattaactttaaatgtaaatggattaaatgctccaattaaaagacacagactggcaaactggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagcctttaaaccaacaaagatcaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgagcacatacttggaagtaaagctctcctcagcaaatgtaaaagaacaggaatgataacaaactatctctcagaccacagtgcaatcaaactagaactcaggattaagaatctcactcacaaccgctcaactacatggaaactgaacaacctgctcctgaatgactactgggtacataacgaaatgaaggcagaaataaagatgttctttgaaaccaacgagaacaaagacacaactcaccagaatatctgggacgcattcaaagcagtgtgtagagggaaatttatagcactaaatgcccacaagagaaagcaggaaagatccaaaattgacaccctaacaccacaattaaaagaactagaaaagcaagagcaaacacattcaaaagctagcagaaggcaagaaataactaaaatcagagcagaactgaaggaaatagagacacaaaaaacccttcaaaaaattaatgaatccaggacctggttttttgaaaggatcaacaaaattgatagaccgctagcaagactaataaagaaaaaaagagagaagaatcaaatagacacaataaaaaatgataaaggggatatcaccaccgattccacggaaattcaaactaccatcagagaatactacaaacacctctatgcaaataaactagaaaatctagaagaaatagataaattccttgacacatacactctcccaagactaaaccaggaagaagttgaatctctgaatagaccaataacaggatctgaaattgtggccgtaaccaatagcttaccaaccaaaaagagtccaggaccagatggattcacagccgaattctaccagaggtacaaggaggaactgctaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctgcttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccccctctcaccactcctgttcaacatagtgttggaagttctggccagggcaattaagcaggagaaggaaataaagggtattcaattaggaaaagaggaagtcaaattgtccctgtttgcagatgacatgattgtatatctagaaaaccccattgtctcagcccaaaatctccttaagctgataagcaactttagaaaagtctcaggatacaaaatcaatgtaccaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagactcaatgtcgtgaaaatggccatactgcccaaggtaatttacagattgaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggcagcaaaacagatatatagatcaatggaacagaacagagccctcagaaataattccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaatctaggcattaccattcaggacataggcatgggcaaagacttcatgtctaaaacaccaaaagcaatggcaacaaaagacaaaattgacaaatgggatctaattaaactaaagagcttctgcacagcaaaagaaactactatcagagtgaacaggcaacctacaaaatgagagaaaattttcgcaacctactcatctgacaaagggctaatatccagaatctacaatgaactcaaacaaatttacaagaaaaaaacaaacaaccccatcagaaagtgggcgaaggacatgaacagacactcctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaattagttcaaccattgtggaagtcagtgtggcgattcctcagggatctagaactagaaataccatttgacccagccatcccactactgggtatatacccaaagaactataaatcatgctgctataaagacacatgcacacgtatgtttattgcggcattattcacaatagcaaagacttggaaccaacccaaatgtccaacaatgatagactggattaagaaaatgtggcgcatagacaccatggaatactatgcagccataaaaaatgatgagttcatgtcctttgtagggacatggatgaaattggaaatcatcattctcagtaaactatcgcaagaacagaaaaccaaacaccgcatattctcactcataggtgcgaattgaacaatgagatcacatggacacaggaaggggaatatcacactctggggactgtggtggggtggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaataaattaattaattaaaaaaaagaaaatatggcttatcccaataacataggatttgtttaagatacaaaaatatacaaaaattatttagtgtaacacattaatagaaaaaagaaaaatattatgtgatcctttcagagtattaaaaaatgactaaatttaatatccactgatgaaaattatctcatcaaactagaaacagaaggacatatctttaatgaatgaagttattaaaaatttctgtagctagtatcatactgaatatgacatagtgcatttcccccctgaagttaaaaacatagcaaatgatttttctctcactttttcatttaacatatgaggagatactggctagtatatataataagtcaaggaaaagaaatagatatagagcttacaaagacaaaaataaactgtctttctcatatgacctcttttgtgtgtagaaaactctaaggaatctaccaaataatacatattaggactaaaaataaatataccagtgttgcagaacatgttaatacgcaaaagttaattctatcttttaatactatcaattaaatgatggaaaataaaattaaggaaatctataaaaatatctactagaggcaattagtgaattccacaaaaattcaggtcactaagtgctatggtctgagtgtttgcattcccctcttattcatatgttgaatcctaatcaacagtgcgatggtttgaggaggtagggcctttgagaattaattagtgcatgatagcagagccctcatgaatggcattagtgccctcatgaaagaacaacttgagagctgccttgtcccttcggccacgtgagaacacgcctagaaggtgtcctctatgaggcagaaaatagccttaaacagactttgactctgctggcaccttgatcatggggttgcccagccacgagaactgtgagaaacaaatctcttttgtttataaggtatcctgtttatggtgttttgttatagcagcactaatgaattaagacactaagttagtatcaaaaaatcacttaatttctatgcattagcaatgaccaattagaaaacaaaatttttaaaagaacaatttacactaacatttaaaaacataaaatactttatggtaaatttaatgaaaaatatttaagacttcttctctgaaagctcattgagtagactctaagagtattttagggatagaagagaagtgaacaaagtcctttttctaaggtaaaaatgacactggtaaagtggagaaaggagcaaatacagtatttttggaattgccaagtagttccttcacctccgtatcatggttcttcaggttccagatgcgaagagtcttaccccatgacacagagactaaaatcaaaccgccactgggtgtaaagctcagatctgctacaacatcttggtggctggaaagattcaaaagcaggagccccgtctgcatctcccatatcttgatctgcctaacattgagtctcatagcaaggaccaggcaagaaacatctggcacttgagggtggttgtgtgcccagagcttcctgctgggtgggaaatgagtaatgaaataaagatatatagcatgtgtatggattaaagcacttcatttatgaatattttaattttccccaaattgatatatagatttaatgcaatctcaatatcctagcaaaaatttacaaataaattaactcactgtttaaaaatttatatagaaaaacaacaaagtaattctgagaaaaagaacagatttagagaacttactctaattcgcttcaagattcattatcaataaaatatataatcatcaggatattgtgatattggtgaaacaaaggaccatgaatggtatggcatagaagaaaaagtttttaaaaattccagataaaagcctcaaatgattttgacccagtagccaaagaagtcaattgggaaacaaaaattatttacaacaaatagtgtttaaacaactatatatatatacacacacacaaacacacatatacacattcatatatatatgaacccttgacttccatatcacatttgaaaattaatagaatatgaataatagacctaacataaaagctaaaagtaaaagacttctgtggacaaaaatagaatatcttcatgacattatttgtggagactcaaaaagtatcactggacattttgctacattaaatcaaatatcactttattttgtaaaatagaaggaggaagagaaaccctgagaggcccttctgtgacaatatattctaaaagatgtaatttctccaaagacatgccaaaatacagttgtaagaaatggtttataaataaatatgaatccatttaataaaagaaaatatgaatactggtttgaaaatgtataattacaatatataaaaatatgcactaagatgcatttttttaaagaacgtagtgatttgtttaattaaaatttgatttctgaagacacatataaaaatttttataaatgaacagaattcatttctaacagaatttgatgaactgttacgtgactaaagtactagtaaagaaaaagaatgttaaattgaggatttattattaacattaagaaaattaggaataaaaaagtatttaaattaaatgagatgcagataattatcaggaaaatagaggatattatttaaataattttatctggatatacaaaattaaaaagaaaataacaatgtttctaaagttgtaacattttcaaatattaagtggagtcaaacacaataaattaaataatcaaaaaggaaatttaaaaaattccagaatctactatgtaaaggctttgacttagtgcactatgaatggcaaagggcataaaatatatcattggtatcaaaaagctcagatcctaactaaaaagataaaagacactggtaaaagaaaggctttgtaaggagcacataaccagtactccatgatttgtgtgcacaagtgctgctggagataagatcgatctttttgaagtatggtatttattagttagaaataaatataaatgataacataaagctatgagttcacagatttattttttctttgtcttccctaagtttaggagtaaagcttactatagtagccatcttgatttgttatcaatcaaaggtagggctgagactgccaaactgtagccctgaaacaaatccagggagcagcatctatgtccaaatacttactctgaatcatggcaatgaactgtgttcttaggatccattccaacaaagtaatccaggaaatcaggtagccagaaaagacaaaatttgtctcactgcacagaaatatttttcttagagaagacaatggaaatataggctttgtttatcatagaaatagctgatatattcttattatgaattaattttattcttttcaatttgcaatagacatggaatacaccttagaatagaagacagaagaacagtatcataatgttaactcttttgttgacaagttgttggaatttctgaaagtcacttaacctccataagacagtttattttcctaaacaaatagaaagtaacaatctcagattgttataactaaaatttagataagataaacaaatgaaagcaagcatatattcagaatacccagtatatctgaaaaaatttcttgacaagaactttatttgggcaattttgtgatattatgcattatcatcttgtttgctctatctgtaaaagaagcaatattgtacttgttcctatttctcctcaaaggtttagtaacatcaaagtggattaataacctgaagtatttatatatatataaaaattcagtgatacatgatataatgctaaaaaagagccagttggtttttatcttggaacttactttctgctgtaaatagagagaaatctatgccttagcagtttctgttcacccataataaatatatatgcaatgctattttattaaaataatcttcattatatattctatctcaataatatctattagtaaaagctattgatatcggtaatatacttgtcattaaaaaattaacaatgctgtatttggcaccatgtaattagggaaggataatattttaatttcttctaattcttactgtaccagattaaaatttttgattttgtggagataacgtcttcaatcaaaaatagtgtttctatttatgataatcttagtccttatgcagatcagttttgtgagctgatatttgctgaagagagatacatttccataaatcatatgaggaatgttgtttaggatcaacactgtaataaggttagctacatcattaggagaattatctttaaatatacacaatttgcttttttttaaaaaaaggtgcagcatgtatctttcatttaatataaaatctcacacaaatatcctaagcaaacctcacaataatggaataaaagcagataataaacttcattttgctatgcaggccagtagtatccacgtatgtaaaatcagagttgaatatttttggcttaaaatacccaatctccgattttcatacaatacactaagccaccataagttaaaacctgaatttgcaagtccaatgactctatgatcctgccagcagtgaacaatgctgattaaggaccatatgtcatttagtgattatttcatgacacaatgatcatttcaaattgctaatgcaacaaaagaaggattttcataaaaatataattttgaatactatttcattttcgagacaaatgcctatttattgtttttttattccctccaaaatcccatggaacaggtcaatatgtaaataagtcattagccaaagggaagggaaataaataaatccctgtactcaaccctaataagatttcagatgagctcctagtaataagcatatgaaaatgatagatacattccctacttcctccagggaatttctatctgacctagttgcaatgctacagagttgagtaggttttctacataaaagtcttgaaaaaatgttaagggaaatttgggaagctttgtgacttctaaaggtattaaaagagaagtgaaataactcaggtttaagtgagtcaaacaaaataaagccttgattttataaaactggaaaaaaagagtaaaacttttgtcagtgattatattaatgtatcatatttcaatataatgtggacatatatatgcatacatttatatatatatgtatgtattggtatttttttctttttcaggactcaaaagcaactggcagattaaaaaaatagctaaaaacagaaaaatatatagctccagagtaccctgaagctaaggccacttgcaatcaaggcccttcataaaatgacagccagcaggtgagcactgtgagacagaggggccaatggagtgcaggctgcttgggccagacaatgcacaagtgattgcaaatgtgtcagaactgtatttcactacaatcacccaacacagcccagggtggtgcgagtttctgttgacaaaattgtatgatgttaagtttctccaatatagaacatattttcaggagaggatgccctggcatctagaatccacgtgcttttatagttaacaaaaaaaaaaaaggaagaaaaagaagaaaataggatttctgtgacccttccctttcaaagaccccatttgaaatatgagaaatgttctgtggaagagaaataagaccatttagaataatgcaggaatttaactagctttgtaggaaaaaagagagcacgtttcactgaaaatttaagtcaaaaatggaaatagcatgcgaggaagacaaaaatgagttgaacaggtccagtttgttgtaaaccaggtctctgagggggagcgagacttaagagtaagctcaattgaaagcagtgagagaaatgtcttaggaaaaaaggacaaacaattagagactaaattcattactcgggatttctacagctacctctcatttctccaccatcattcctgcttgccccaacattcatccttgaagtccggggtattattgcttagcttgcttgagattttgagttcaggatgaaggatgaaagagaatttaggtcaatttatctagtcaatgtattaaagttgcacgccaatgaaaacattgaaagatttgttacaaaattataaaactacattttttgaatcatactacggactagacataggtatgaagctcaacacctaaattattaatttttataaaaatatttgataggctgggcgcagtggctcatgcctgtaatcccagcactttgggaggccaaggcaggcggatcacaaggtcaagagagcgagaccatcctggccaacatggtgaaaccccgtctctattaaaaaaaaaaattagctgggcgtggtggcacatgcttgtagtcccagctactccggaggctgaggcaggagaatcacttgaacccgggaggcagaggttgcagtaagccgagatcgcgccactgcactccagcctagccacagaactagactctgtctcaacaaacaaacaaacaaacaaatatttgataaaatttaatattaaatcataagtatgctataatctggttaaaagtatagataataattatataaaaatgaatattagaacaaattttttcaaacttttaaagagaagaaaatagaaaaagacaggattagaacaatgattcttcacaacatatacactatgagttatagaatgatatcactggagaagaatcaaggcaagttaataataacttttacttactgagcacttagtaagcctatgataattaccagttattatcatatgccaaatactgtgctaagtattttcataatgtattatattctatcaaaataactggtctatgggaacagatttgatatcctgttttccagacaaagcgtagttgcagatactcagtaactagtccatactcacagggtcagtaaatgacaagtatttgaattcatacttccctgactccaacatttattattttgtctactgagctatgtatatttttaatatcataagctatctccagactcagagataatatacaactcttagactgtggctcc

SEQ ID NO: 564 - DNA, 58092 bp, Homo sapiens
agaagccctacaaacttttcacacgtaagcatactaactcaatgaatgtaattttcatgaaactgtttaaaagaagtccttctcacccttcacatttgtgttacaccttctcagcttccccaacgtgactgaatgaatgtactggaatctgaactccctggaggcaggaccattggcctaggcatctttgtcttcttagtactaggcattcaaatgagtgtaaggtttattgacatgtctactcagaacacctttgtgctgagctcgcaagggttttttttttttttttaaagatagggttctgctctgtcgcccaggctagagtgcagtggcacaattatagttcactgcagccttgaactcctaggctcaagtgatcctcctgtcccaatgttccaaagtgctgggaatacaggtataagtcactgtgcccagtagttattttataatagaaattacatcattaggccaggcgtggtggctcacgcctgtaatcccagcaatttgggagtccgaggtgggtggatcacctgaggacgggagctcaagaccagcctagccaacatggcgaaaccctgtctctactaaaaacaccaaaaattagtcaggcgtggtggcaggcgcctgtaatcccagctacctgggacatgtaaaaaaaattacatcattagtatatccagaaaatggtagatcctacctttatatgttactagatgttgtcaaaatattttattggtcagaattaatacaaatctctggtttatggaattttgtaccttttaaggtatatatactggcctgagagtctgctgccagagaggaaactatttatttggcccagtagtatctttttcttccgaaaaactactatactaggccaggcgtgatggctcacacctgtaatcccagcactttgggaggctgaggtgggtggatcatgaggtcaggagttcaagaccagcctgaccaacatggggaaaccccgtctctactaaaaatacaaaaattagctgggcgtgcaggcgcatgcctgtaatcccagctactcaggaggctgaggcaggagaattgcttgaacctgggaggcggaggttgcagtgagctgagatcgcaccactgtactccagcctgggcaacagagcgagactctgtctcaaaatacaaaaaaaattttaaaaactaaaaaaaaaactatgctacatataactaaacacaaatcagtttctaaagtctgaatgccttacccttctgaggtataaattaaggttaagattttgagactggaagatgtggccactgtttctagctttaatgctgtgaaacctagcataagtcacacagagtaagaaacaaaaacctccctaagtaatgaaagttccccacttacttcaggaagattttgtaaagatagtagatatcaagaaactactctgaattcattggagaaaatccgtaacctagaaagaatcaactcaaaagaatttcaacatgggaatgaaactgctatgcatttaaaagccattgccagatttgagggcaatatttgattagttttttgcctttggtttctattcaactagacatctgacaatcctcttgtggtaaacacatctttattaaagttggaatacacttcatttacctaaaaggaagctgaacatttaaaatgcaatcaaacgtatttgtcacaaattcaaaaggttaaaaaatgtaattggccaggcacagtggctcacgcctgtaatcccagcactttgggaggccaaggcggaggaatcacaaggtcaggagtttgagaccagcctggccaacatggtgaaaccccatctctactaaaaatacaaaaaattagctgggcgtggtggtgggcacctgtaatcccagctactcgggaggctgaggccagagaatcgcttgaacctgggaggcagaggttgcagtaagccaagatcgtgccactgtactccagcccaggtgacagtgcgagactccgtctcaaaaacaaacaaacaaacaaaaaaagtaattaagggaacttcttaccgatagataataaaataaaggactgagacctaactaaagaataagggacagggccgggcgcagtggctcacgcctgtaatcccagcactttgggaggctgaggtgcgcggatcttttgaggtcaggagttcgagaccagcctggccaatatggtgagacccctactaaaaacaaaaattagccaggcgtggtggtgtgcacctgtaatcccagctacttaggaggctgaggcaggagaatcccttgaacccaggaggcggagattgcagtgagccgagatcgtaccactgcactccaaggtgggtgaggtgacaaagcaagactctgtctcaaaaaaaaaaaaaaaaaaaaaaaagaataagggacaagaaggaggagcagagaaaaataaaaagaagaagggactggactgaatggaggaacccacagtcatcccacagcatgagggcttctgaggctttagggacaaagcagcaaccctgaacagatgtcattatgaactcataaagtgaaccacttcagcagcactaatgtaggctaagtactaaatgctactcttgaaaatatactgttgaatgagagatttaaagaagatcataaagtgattcaatctaagacaataagccttcttatgaatataccacggttatcattttatcaactcaaatgaaaaagttatagaaagtagaaaaaggataaaataaaaaattctaccttactccgtgcattcaacaaatatcaatgaaacatttgctatatgtaaaaataccgtgcttattgcaagcttgactgctatcaaatattaaaaacacaaaaagaaaaaatatattatgcttagatcccacacagggtacaaaaagaagatatgtcactatttgctgtcaaacagatggacccactaagggccaaggacacataaattaataataccaacacagaacattatataataaatgacctatgagacaaaacaagaagccttaacagttcaagaaagaaagagatggcttctaactagtataaggaaggttcacagacaagcatttcagctgagctctaaagactaggtagaagccaagtgtggtgactcatgcctgtaatccaagcactttgggaagccaaagcaggcagaaaacttgagtccaggaatttgagaccagcctgggcaacatgacaaaacccttctctacaaaaaatacaaaaattagttggccatggtggcgcacacctgtagtcccagctacagggggtctgaggtgcgagcatcgcttgagcccaggagttagatgctgcagtgagccaagatcgcgcaactacactctagcctgggtgacacagcaagactccgtttcaaaaaatcaaaaaacaacaacaaaaataaagaagaggtagaatttcagagaataaaattggggaaggtgaagggattaaacattgtcaaattattgtaacttaaactgatatcctttgccacttacagaattacctttagagctgggtgcagtggctcacaccagtaaacccaacactttgagaggccaaaacaggcagattgcttgagcccaggagttcgtgaccagccaaagcaacaaagtgagaccctgtctctataaaaaatacacaagttagccaggcatggtagtgcaaacctgttgtcccagctacttgggaggctgaggtgggaggatctcttgagcccgagaggtggaggctgcagtgagccaatatcatgccactgcactccagcttgggcaacagagcaagactctgtcccaaaacaacaacaacaaaacagaattacctttaagacaaaacaaaactaaactaaaaaacacattttttacccaattgtttttaagtacacagtttaatattttaaattctacattaacgaagcatataatctagagactccttattattgacagtctatgttttgaccaaaaaaaaagcctagaaatagaataatttggcataaccattgttgctattagcaaactgtgagctattatgacaaattcaggaagctattttataaagcataccaaatttcataacagataccagctgcagtttttaaaaatggtgaactcattagtgtgctacccaattaagattcccttaataaaacagaaaaaatttaaaaatggaaaaataaagtattccacaaactacccatcaatatactttcttttttttgttgttttgtttttgagagagtctggctttgtcacctaggctggagtgcagtgaactcactcgagcgattctcctacctcagcctccagagtagctgggattataggcatgcgtcaccacgcccaactaatttttgtatttttagtaaagacagggtttcaccatgctggccagggtggtctcaaactcctgacctcaggtgatctgcccacctcggtctcctagagtgctgggattacaggcgtgagccaccacacctggccgaaaatttcatatggagaaccatacgttttaaattcagcaaaatgctttatttggtagaaaggtaaaatggaacttcagtgcccaaatttgtgtgtgtgtgtgtgtgtgtgtgtgtgtgtgtgtctgtgtgtgtctgtgtgtgttttgagatggaatttcgctcttgttgcccaggctggagtgcaatggcacgatctcggctcactgcaacctccacctcctgagttcaagcgattctcctgcctcagcctcccaagtagctgggattacaggcatgcaccagcatgcccggctaattttgtattttttcgcaaagacggggtttctccatgttggtcaggctggtctcgaactcccgacctcaggtgatccatctgcctgggcctcccaaagtgctgggattacaggcatgagccaccgtgcccagcctctttattgttaatacaactactcgagttttaaaatttcttcttgaggccaggtgcagtagttcatgcctgtaatcccagcactttgggaggccaaggcaagtggatcacttgagttcaggagttcaagaccagcctgggcaacatggtcaaactccatctctacaaaaaatacaaaaattagtggggtgtggtggtgcacacttgtagtctcagctactcaggaggccgaagtgggaggatcacttgagcccaggaggtagaggttgcagtgagccaagatcacaccactgtattgcaacctgggcaacagaaccaaaccctgtctcaaaaaaaaaaaaaaaaagaaaaaaattattcttgagttaattctgataggtgatgttttttctaggatttataagtcatctaaaacacgtaagccagaatcaactacacctttcattactcacataatttaaacaaacaactaataaaacatggagatgagctacataaatgtcatctaagtaatggctaaaggcccttaaacaagataggtctgctctgaaaacattcagtttactatgaaccatttaatcttcctaatcccaaaaggtgtcaaccaggaagcctgctcacttacacagcaccatctctctctcaccatctctctctatgacccacttctaaatgtcattttaacttccttttttccccattagagtgtacactacttgagagcagagactaagccatattatctttgtacatctggcacattagtagacaccttaacaatatcggtacttttttgatgaagatcataaagtaccttactgacgagggatgttaatgactcacttacggttgcaaagtatactcttgaggtgttcagtgttgaaagacttcactgaaccgtactttcacatggccttgcttatgaccaaaagcacaaagccatctgtaagacagttcatcttagttgggagtagagcataaaatgtatttttcttcactgacgaattaactgaaataaaaacaaatcttaagcaaaggcataattacacttttatgtaaatgtgcaatactgtcagaagcctagctgaaaaaccaaaaagtaaaacaaaacaaaaatgctaacttttaatcgtggtaagtcccagaagaaaaacattaaaaggagttcaaaattagaaagataaatagattcagagttaaagatagagcctaaactattttgcccaaaccattcaattctttaaagcattttaaaatccaagtaacacagaaaagtgaccatcctaagagtagagcttgatgaattactgcaaagtaaacacaatctcatttattttaagatgggaaagtttttgttttgttttttaagacggagtctcgctctgttgcccaggctggagtgcaatggtgcaatctctgctcactgcaacctctgcctccaggttcaagcgattctctcacctctgcctcccaagtagctgggactacaggcacacaccaccacacccagctaattttcgtattttagtagagactgggtttcaccatgttggccaggctggtctcaaactcctgacctcaagtgatccgcccaccttggtctcccaaagtgctgggattacgtgtgtgacccactttgcccagccaggacagtctgaaacaatcaaaatgatagacatatccaagtcacgcagcttatactgacaagtgccactgtgagaaattccaaggttttctataaaactggtaagactcaaagctcacaacccacatttgtcaaaacccacagcatcaaagagtgaaatttaatacatgtaaatttttaaaaaaaaccacttactcaggaggctgggggatcctagattatgataaaacaatccaactatattacaaatatatgagaccaccttgggtggaggaaaaggtgtaacctaagtaactttggaaataaggggcatctataaaactaaaggcaaaagaaacttcatataagcactagtctctacttgacaaagttgtttctcacaaaagcagaggctaacaatactaatctagctatacatgtatattggcattgaacgattaagtaaatagttggcagatggctagaccaaattttcttattggagtgggaatttacaaatagtcaaggaaggaagatagaatgatcctgtgataatggattagagtgggagacaggatgaactcatgtttaaatagatacagatggttacatataaatatttacaattggtgcataatatacacacacacacatatatacatgtgttagtatacactcatctaccaccttgttctgttaactgcaagggcctacaagtaataagcatacctagcacccagaagttctttctaataccgttctccaataaaagaaaccagggctccttggtgaaacggcagaatctaggaggacaggaaatatataagatgagcctggagaatccagtactgccacaaagtaaggaagtgccctaaaaacaaaacaaaagaaaattgatgggattggccgggtgcggtggctcacgcctgtaatcccagcactttgggaggctgaggcgggtgaatcacaaggtcaggggttcgagacaagcctgaccaacatggtgaaaccccatctctactaaaaatacaaaaattagctggccatggtggcgggtgcctgtaatcccagctactcaggaggctgaggcacgagaattgcttgaacccaggaggcggaggttgcagtgagctgagattgtgccactgcactccagcctgggcaacagagtgagactctgtctcaaaaaaaaaaaaaaaaaaaagaaaattgatgggattgtgtaaaaggggcaaaggaggcagatgaaagagctcctgatggtcaaaactgaaacaactgggccataaaataaattggtattggatcaaaaccccaagtacaggccaggtgctgtggttcatgcctgtaatcctagcactttgggagactgaggcgggtggagtgcctgaactcaggagttcgagatcagcctgggcaacagggtgaaaccccgtttctactaaaatacaaaaaattagccaggcgtggcggtgtgcgcctgtagtcccagctacttgggaggctgaggcaagagaactgctagaaccaaagaggcagaggttgcagtgagccaagatcgcaccactgcactccagcctgggagacagagagagactccatctataaatcaatcaatcaatcaatcccaaagtacaaaatgaatatccacaaattcatattgatataactgattaagaaaaaaaaaaaggctgggtgcggtggcttatgcctgtaaacccagcattttgggagaccgaggcaggcagatcacgaggtcaggagtttgagaccagcctggccaacatagtgaaaccccatctctactaaaaatacaaaaaattagctgggcatggtggtgcgcacctgtaagcccagctactcgggaggctgaggcaggagaattacttgaaccaaggaggcagaggttggagtgagccaagatcttgccattgcactccagcctgggaaacagagcaagataccatctcagggcgggggaaacaaaaaggggggaatctcccctgcagatttccaaataattcgtgtatgtacgttttcctctcacagtagtagagcataatttcccctaccttcctaacttgtctccacctaggtgaagttattatattattatcacacaatgtagctagacactaagctagttttacaatggacagaaagtaatttcattcctgcataccttgggcaaataaaactttctgtgtatctatgtcagaaaattcataatggggaaatgaagattaaaaaatttaaagtaggcagggtgcaggggctcatgcctgtaatcccagcactttgagacgccaagatgagaggatcacttgagcccaggagttcaagaccagctggggcaacacagactaggccctgtttccacaaaaaaaatttaaaaattagctgggtgtggtggcagctacttgggggctggggtggaaggatggcttgagcccaagaggtggaggctgcagggagctatggtcttaccactgcactccagcctgtgtgacagagtgagatcctgtcccccacaaaaattaatttatttggccaggcacagtggttcatacctgtaatcccagcactttgggaggttgaggcaggcagatcacaaggtcaacagattgagaccatcctggccaacatggtgaaaccctgtctctactaaaaatacaaaaattggccaggtgcggtggctcacgcctgtaatctcagcactttgggagaccgaggaggtgaatcacctgaggtcaggagtttgagaccagcccggccaacactgtgaaaccccgtctctattaaagatacaaaaaattagctgggcatggtggtgggcacctgtaatcccagctactcaggaggctgaggcaggagaatcactttaactcaagaggcggaggttgcagtgagccgagatcctgccattgcactccagcctgagcaacaagagcaagactctgtctcaaaaataaaataaaataaaaatacaaaaattagctgggcatggtggcgcgtgcctgtagtcccaactactggggaggctgaggcaggagaatcgcttgaaccaggaggcggaggttgcagtgagccaagacagcgccactgtactctggcctagtgacggagtgaaactccatctcaaaaataataataggctgggcatggtggctcacgcctgtaatcccagcactttgggaggccgaggtgggcggatcacgaggtcaggagttcaagaccatcctggctaacacggtgaaaccccgtctctactaaaaatacaaaaaattagccgggcatggtggcgggcgcctgtagtcccagctactcaggaggctgaggcaggagaatggcgtgaacccgggggaggcagagcttgcagtgagccgagatcgtgccactgcactccagcctgggcgacagagcgagactctgtctcaaaaagaaaataataataataataataataataataatttaattaaaaagtaaaaaccggcttggtgcggtggctcatgcctgtaatcccagcaatttgggaggccaaggtgggtggatcacctgagctcaggggttcgagaccagcctggccaacatggtgaaaccctgtctctgctaaaaatacaaaaattagcccagcctggtggtgggcacctataatcccagctattcagaggctgaggcaggattttcacttgaactagggaggcggaggtttcagtgagccgagatcgcactactgggcaacagagcaagactcagtctcaaaataaataaataaataaataaatgcagccaggcgcggtggctcatgcctgtaatcccagcactttgggaggctgaggcgcgcagatcacctgaggtcaggagttcgagaccagcctgaccaacatggagaaaccctgtctctactaaaaatacaaaattagccaggcatggtgatacacgcctgtaatcccagcactcgggaagctgaggcaggagaatcgcttgaacctgtgaggtgaaggttgtgttgagccgagatcgtgccattgcactccagtctgggcaacaagagcaaaactccatctccaaaaaaaaaaagaaaaagaaaaagtatatgatatcagttgctggttatatctcattagctttaatagttagtcacttctgatacagcatatgttttgttcattctgggataacagatttaggacagggaaaaacaagtgaaataaaaatgtaatcccctctttgccacctttgataaatttaatcacatacactgagagctttgcttgcacttaaaaatgacagtaaatttataggttaaaattttaaaattgttccaacaatgggaggcacattgttattattaccattgctatagttgaatgaaggaagattaaatatatctattattctccaaaaaaaatgcttatggaattgattaaaagatttaataaatgacattgctatattgtgatttagtaagcaaataaagttatcctcctggaggttggaaaataaatcttacttggtttaactactcctattaacaatgtttcaactaatgaatttcttttccttttttttttttttgagacggagttgttctgtcactcagggctggagtgcagtggcacaacctcagctcactgcaacccccgtctccagagttcaagtgattctcctgcctcaagctgctgaacagctgggattacagacatgtgccaccatgcccagctaatttttgtatttttagtagagatacagtttcaccatgttggtcaggctggtcttgaactcccgacctcaagtcatatgcctgcctcggcctcccaaagtgctgggattacaagtgtgagccactgcgcctggcctcgactaatgaatatttttgataaaatgaataaaattatcaggcaatagtgaccaaagcatgtcatgaatttaacaatgagaagagtagtggctttttccaacagatttcaattcagtcatctgaagtacttgtttgtgaaataccttaaactcctttctcatttctagtctctgctcttgctggccatcccctcttgcagaaataccgtactcctacttgccagtaggacaaattcctactctgccacgtaagagttacctcttcttgaggttctatcccctccagccaattaagtattcctctgaccttctattcattttgtacagtatcttcattatctcaaagttatataaatatttgttgagagaggtggcctacaagacgtaagccaacattagataaatactagagatagtttctacttttcaccacttcataagttacaattttgcttattaaccacttgcctaattaaaacccacattaagagccaggagtggtggcttatgcctataatcacagcaactcaggagactgccaccagaggatcgcttgaggccaggagttcgagaccagcctgggcaaatagtgagaccccccccccccatttccaagaagaaaaaaaaaatgctaggtatggtggtgtgcacctgtagtcccagctatgtgggaggctgaggtgggaagatcacctgatgattgcaccactgcactccagcctgtgacagtgcaagacgatctcttaaaaaattaattaaaatatgaaaaaataaaatccacattttacttctcattgctatggcttccaataaagtcaagacaaggcaagagcactaaagcaatcaagatgcaaaaatgcacagccacgagtttgctttaaggaaaatatgccttaagatgtggtgtccagaaatgtgaaaattgccaataccaattgtctttttatgtgtgttgaatcatactgtatttcagatgggtagtgttatggctgaaaactgttaatactagttcaattttaacagtcagcatttaaagggatggaatccagaaaactaatttccatctctgaccttctataaatttgctatgatctcaggaaaattgattttgcatactgtatcaactgtacggtaaaaataataatccatcagaaacttcaaaaggctatattctgtaccatttctatgaaaataagtgatgactgtgcagaatacaaatatattcaaagatagcttataatatgaaattcagctaccagacagaaatatggggaggacagaagtgttcacttcatttaagactgattctaggccgggcccggtggctcacgcctgtaatcccagcactttgggaggccaaggcgggcagatcatgaggtcaggagatcgagaccatcctggttaacacggtgaaaccccgtctctactaaaaatacaaaaaattagccaggtgtggtggcgggtgcctgtagtcccagctactcgggaggctgaggcaggagaatggcgtgaacccgggaggcggagcttgcagtgagcggagatcgagcctgggcgacagagtgagactccgcctcaaaaaaaaaaaaaaaaaaaaaacagactgattctacagataagactaatgacctgagaacacctccctggcacttggagcaaaaggccagtgatatggtctatgttaaacagtccacttttcaataatgtttaaaataacccacaactaacaacataatttcactgcttcatgtttactattctgtatcagtttacaaactaaaattaaactgacacacacttaacagaattcccgacaacacaataacattaccatacaaaagataataccaaggttgttatgagttatctagttctctgttacttccttaatgctgtaaactacaaatcagaaccccaaataggagaaatgctaaatagaaagtacataaagatgactcatacaggcaaacaggtatgcaaaaacattcaaagttctctcattcttaaacactgaaattccttaaagcaaatacaaattaaatggagttctagaagggtaaacagtgatccttagtatcaggaagaaaaaactattttaataatggccacgcgcagtggttcacacccgtaatcccagcactgtgggaagccaaggtgggcgaatagcttgagcccaagagttcaacaccagccctggcaacacagcaaaacctcgtctgtacaaaaaaaaaaaaaaaaaaaaaaaaaaaattagccaggcttggtggctctgtctcaaaaaaaagagaaaagaaaataaataaaattaccaacatggtggcttgtgtctgtatcccagcgactcaggagtctgaggtgggaggactgtttgaggccaggagtccagctggggcaacatggtgattctcctgcctcaacttcccaagaagctgggactccaggtgcacaccatcaagaccagctaatttttttattttgtagagccaggatttcgccacatcgcccaggctggtctcaaactcctgggttcaagtgatcctcctgtattggcatccaaaagtgctggaattacaggtgtgagacaccatgcccccggctcatatcacttcctaactaatctgccacaattagagagaattagctggtttcccacttccttccttcttccttcttcaatctattctttatttcgctgtagtattaaacttcatgatgcaaatctggatcaaaaacttttgactgggccaggcacagtggctcatacctgtaatcctaccactttgggaggccgaggcgggtggatcaccagaggtcaggagttcgagaccagcctggccagcatggtgaaacaccatctctactaaaaatacaaaacattagctgggcgtggtcgtgggcacctgtaatcccagctactaaggaggctgaggcaggagaatcgcttgaacctgagaggcagaggttgcagtgagctgagatcacgccattgcattccagcctgggtgacagtgcgagactccatcgcgccaaaaaaaaaaaaaaaaccttttgactgttttaaggcctattctttaaaattcaaggtttttaaattttgttttgtttttgagatggagtttcgctcttgttgcccaggctggagtacaatggcgcaatctcggctcattgcaacctcactgaacacctcctgggttcaagcgattctcctgcctcagcctcctaagttgctgggattacaggcgcctgccaccatgcccggctaatttttctgtttttagtagagatggggtttcaccatgttgcccaggctgatcttgaactcctgacctcaggtgacctgcctacctcagcctcccgaagtgttgggattacaggcatgagccaccgcgtctggcctaatcttactttttgtgtgcctctcctcactctggtctattcctctctccttcagccaaatgatcgtaatattctctcttcccacctctatgatcctttattcttgctgcccttttttgtttgtttttgttttttttttgagatgtagtctagctctgtcacccaggctggggagcagtggcgtgatcttggctcattgcaacctccacctcctgggttaaagcagctctttgcctcagcctcctgagtagctgggattacaggcagacaccatcacgcctggctaagttttgtatttttaggggagaggggtttcaccatgttggccaggctggtcttgaactcctgacctcaagcaatccacctgcctcggcctcccaaagtgctgggattacaggcatgagccactgtccctagctgggccaaggtttaatttggacatattcatagaagaaggatgtctgggctgggtgcggtggctcacgcctataatcccaacactttgggaggctaaggcaggtgaatcacctaaggtcaggagttcaagaccagcctggcaaacatggtgaaaccccgtctctactaaaaaatacaaaaaatagctgggtgtggtggcaaacgcccgtaattctagctacttgggaggctgaggcaggagaatcacttgaacccgggaggtggaggttgtggtaagcagagatcatgccattgcactctagcctgggcaataagagcgaaactctgtctcaaaaataataatataaacatttctgcaattggactgtctttccaaacacaagtgcacatattttatctaaaatagtttcagctaagagtgcacagcaaaaacaactgtccaaagataaaagaacaaccaaatcattaggtactcagaggaaatctcattcaatatctcctaaggttccaatgcttctcaaattttaatgtgaatctagtttatagattcagattcagtaagcctcgggtggaacttgacactgtattctcaccttgatgatgccagcactgccagtttggggaccttgagtatcaaggtcttcagtaaccattaaaatgtagctggtatcaacactagatgagaaaatggaatcaacaggtattgagaacatgtgccaggtgccttatctcatttaatctttacgtcaactctgtgaggaacatattatcaattctaagatgaggataagatgaggaaaattgaggctgagataaattaacttgcccatgattacacagaaccagatttgaacccaatcataggactccatttattctttttaagagatactataaattgtcattgaaattaacttcaaaccatcctcaaaagaataataggccaggccaggcacagtggctcacgcctgtaatcctagcactttgggaggccaaggtgggcggatcacctgaggtcaggagttcaagaccagcctgcccaacatggtgaaacccccgcctctacaaaaaatacaaaaattagctgggcacggcgacaggcacctgtaatttcagctactcgggaggctgaggcagaagaattgcttgaacccaggaggcagaggttgcagtgagtggagatcgcgccactgtactccagcctgggagaaagagcgagactccgtctcaaaaaaaaaaaaaaaaaaaaaaaaaaaaaaaaagaataataggccaaacacagtggctcacgcctacactttgggaggccaaggagggaggattggccgggcgcggtggctcacacctgtaatcccagcactttgggaggccgaggcaggtggatcatgaggtcaggagatcaagaccatcctggctaacacagtgaaaccccgtctccactaaaaatacaaaaaattagccaggtgtggtggcaggcgcctgtagtcccagctactcgggaggctgaggcaggagaatggtgtgaacctgggaggcagagcttgcagtgagctgagatcatgctccactgcactccagcctggacaacagagcgagactccatctcaaaaaaaaagagggaggatcgcttgagcactgaagttgaggctgcagtgagcctctgcactgtagcctgaggaacagagtatggccctatctccaaaaaaaaaaaaaaaaaaaaaagaataacaatgttgcatgacatcttgtcttggatacagactttcactttcctctattacctgtttcttcaaaacgtcctaccttttattgttatccccctgctttgatgctgggcattgtcatccacacttgaaccaaaatagtagacacctacctaactgttctgactctagccttttgcctcatcaatctagagattattctgcagtctccaggaatttactaaatgtgagcagaccagtagcatggtaaaaacagtgtttcaagaggaattcaaagtactttacaatcccacaatgctcctatcaaatctctcgggtggcatataaacctagcttccccactgataaacaaaaatattctgcaaagaacataatacattttaacaagatgctgtgatggaatggaacattttatttccatttgtcttttttttttttttttttttttttgagacggtgtttcgcccttttccccaggctggagtgcagtggcacaatcgcggctcactgcaacctccgcctcccaaattcaagcaattctcctgcctcagcctcctgagtagctgggattacaggtgcacatcatcacccccggctaatttctgtatttttagtagagatggggtttcaccatgttggccaggtggtctcaaattcccaacctcaagcgatccacccatctcagcctaccaaagtgctgggattacaggcgtaagccaccctgcccagcggtcatttatcttttttctagtggtggtcagggcaaaggaatgccttcctgcttctgcctcctactcacttctctagagcagaggagaggacctccttccatcacaagtcatttcctactccattccacattaatcatttccagaagtccatctataccattacttatcgacacaatgtcacactatttcatattgttatagtttttttgtttttgtttttttgagatgaagtctcactgtgttgccaggctggaatgcagtggcatgttcttggctcactgcaacctccgccacctgggttcaagtgattctcctgcctcagcctcccgagtagctgggactacaggtgcgtgccaccacgcccagctaatttttgtattttcagtagagacagagtttcaccatgttggccaggatggtcttgatgtcttgacctcatgatcagcccgcctcagccatccaaagtgctgggattacaggcatgagccaccacacccagccatagttatgttcttatgtaaattttctcaataaccagattacacatttttggttaatacttgcacagctgaacagattatgaatttatgaaaggtagataatgtcttgattacatcttatccccaggaaacctaaaggacagtggtgtatatgcacatgaagtaaatctttgcttcacctgatcataaaaatcacctggccaagcacggtggctcacacctgtagtcccagctacttgtgagtctgaggtagaggatcacttagcctgggaaatccaggctgcagtgagccatgattgtaccactgcgctccagcctgggtgataaagcaagaccctgtctcaagaaaaaatttaaaaagtaaattaccatcctggctaacacagtgaaaccctgtctctactaaaaatacaaaaaattagccaggcgtggtggcaggcgcctatagtcccagctcttgggaggctgaggcagaagaatggcgtgaacccgggatgcggagcttgcaatgagccgtgatcgtgccactgcactccagtctgggcgacagagcaagactccagtctcaaaaaaaaaaaagtaaattaaaaaaattaaaaatcacctagcaggtagatttcctggagactgtttcagaaaaataggcatgaaagcagaaatcttaattctatcaacaagcaccacagatccaaatccagaaaacctttggtagtactttttttttttgagacggagtttcactcttgttgcctaggctagagtgaaatagtgccatctcggctcactgcagcctccgcctctcccaggttcatgcaattctcctgcctcagcctcccgagtagctggaattaaaggcgcccaccccgcccagctaattttttgtatttttagtagagacggggtttcaccatgttggccaggctggtctcaaactcctgacctcaagtgatccacccaccttggcctcccaaagtgctgggattacaggcgtgagccactgcgcccggccaaccctctactgagggttagggttttgccatgccaaggttaagttacttctaaaacttaaccttatgttctcatttataattttcttacaatgctttatacactttactgagcaataggcttaaaatacggttaataaaacttgcagaaaaatacaaaatagtataagcaggagtagatattatagaacaactgaacccttatttcacaaatgaggaaagtgaggtcagaaaacctaagtggctttaaggtcatacagccaatgagtagcaaaaatagaaactgtatcttttgtctttcagcccagcacttcttctattgtaccataccaaaatttatttataaaaaatcagcagtaaagcattatttactaatgtccatcaaaaacagaccagttgaacaaactctggtgcatcctcactgtgtaggtgtggaaatgaataaggactacctctgttccaatatggaatgatctccaaaatatactaggtgaaaagaccaagaggctgagcagcgtatatagtaggaaaaccttttgcataagagaaaaaaagaatatatgcagatatttgcttattattgcaaaatccaacatttaaaggataaaccaaaaccaaataaatattagaatggttcaagcaccaaccatgagacaacccttggcaattcctcctcaaagtcccagctataaaagtggtagtaggctggaagccgtggctcatgcctgtaatcccaacactttgggaggccgaggcgggcagatcatgaggtcaggagttcgagaccagcctgaccaacatggtaaaacaccgtctctactgaaaatgcaaaaattatttgggagtggtggtgcacgcctgtaatcccagctactcaggaggctgaggcaggagaatcgcttgaacctgggaggtggggaggcagaggttgcagtgagccaagattgcacccctgcactccagcctgggcaaccaagtgagactgcgtcttttaaaaaaaaaaaaaaaaaaaaaaaaagtggcagtaagtttgagtggtggtccctactatttgatattcttaaaagttctgggccgggtgcggtggctcatgcctgtaatcccagcgctttggtaggccaaggcgggcggatcacctgaggtcaggagttcgagaccaacctgaccaacatggagaaaaccccgtctctactaaaaatacaaaattagccaggcatagtggcgtctgcctgtaatcccagctactcaggaggctgaggaaggagaatcgcttgaacctgggaggcggaggtcgcgatgagccaagatcgcgtcattgtactcaagcctgggcaacaagagagaaattccgtctccaaaaaaaaaaaaaaaagttctgggccaggcgcagtggctcatgtctgtaatcccagcactttgggagtctgaggtgggtggatcacctgagcccaggggttcaggaccaccctggacaacatggcaaaaccctaactctacaggccaggtgcagtggctcacgcctgtaatcccagcactttgggaggccaagacgggcggatcacttgaagctgggagttcaagaccagcttgaccaacatggagaaaccccgtctctactaaaaatacaaaattagccgggtgtggtggcacatgcctgtaatcccagctactcaggaggctgaggcaggagaattgcttgaacctgggaggcggaggttgcggtgagccgagatcacgccattgcactccagcctgggcaagaagagcgaaactctgtctcaaaaaaaaaaaaaaaaaaaaaccctaactctacagaaacaatggacacggtggcacctgcttgtagtctctgctactagggaggctggggtaggagggtcacctgagcctggggaggtcaatgctggagtaaaccgtgatcgcccactgcactccagtctgggaggcagattgagatcctgtctcaaaaaaaaaaaaaaaaagttatagtaataccatctcctcccttttgttcccctgacccttaatagtttcaccctacagtaattaatttctaagttacctactgctatggtttagataaggtttgtcgccaccaaaactcatgtggaaatttgatccccaatgtggtggtgttaggaggtggggcctactgggtggtgtttaggtaatgggggcagatctctcatgagtgacttggtgctgttctcctggtagtgagtgagttctggctctccgaaactagattagttcctgggagagtaggttgttataaatcaggccatccccaacgtttcccctattcacatgtcaacttcccctttgacctttcctgccacactgtgatacagctggaaagccctgccagaagccagggccatggacttgaacttcctagcctgtagaaccatgagctaaataaacctcttttctttatataataaattacttaatctcaggtattctttacagaaacacaaaatggactaagacacctactctaccatcttttgcccttctggtgttataacacatatgtaaccaattccctatattaaatttcctctttgaaatatttagtatattttccagtttttggctggatcctgatggataaaaaattctaaggatttagaagaactgcaggctaggcgcagtggctcacgcctgcaatgccaacactttaggtcaaggcaggtggaggattgcttgaagacacgaattccagaccagcgtgggcaacatggcaaaactccatctctacaaaaaacacaaaaaaattagcctggcatggtggcatgtgactgtagtcccagctactcaggaggctgagatgggacagtaacttgagcctgggagggagaggttgtagtaagcagagattgcaccactgcactccagcccaggtgacagagccagaccctgtgtctaaaaaaataaaaatcaaaaaaattcccagcactttgggaggccgaggcaggtacatcacgaggtcaggagttcaagaccagcctcgccaagatggtgaaaccccatctctactaaaaatacaaaaaattagccaggcgtggtggtgggtgcctataatcccagctacttgggaggctgaggcaggagaatcgcttgaacccaggaggtggaggttgcagtgagcccagatcgtgccattgtacttcagcctgggtgacagagactacgtctcaaaaaaaaatattggccaggtgtagtggtgcccacctgtagttctagctactcgggaggctgaggcaggaggatcgcttgagccaggagattggggctgcattgagccataatcacaccacactttagcatggcaaaaaaaaaaaaaacaacaacaaaaaaagaaaactgcaaagggatcttttttttatttttttgaaacagagtttcactcatgttgccaaggctggagtgcaatggcgcaatcttggctcaccgcaacctccacctcccaggtttaagcgattctcctgcctcagcctcccaagtagctggaattacaggcatgtgccaccacacccagctaattttgtatttttagtagagatggggtttccccattgttggtcaggctggtctcgaactcctgacctcaagtgatccacccgtctcagcctcccaaagtgctgggattactttaagttagcttcaggtattttattagtagtaatatggaatatatataatttttttttttttttttgagacagagactctaccgcccaggctggagtacagtggcttgatctcagctcactgcaacctcggcctcccaggtacaagtgattctcctaccacagcttcccaagtagctgagattacaggcacataccaccacacccagctaacttttttttttttttttttttgtattttttagtagagacggggtttccccatgttggccaggctggtgtcaaactcccaacctcaggtgatctgcccacctcagcctcccaaagtgctgggattacaggcgtgagccacagcacccatccagttgttacatttttaaaccttcttatacatacataggataaagcaaataaatgttaatattattaaaaccaaatatttcagtatgagacaaatataaaatcaaaagaaaaaatcccataaatgtgttaaattcagttgtaaatatcaatataaagttctgatttctaataatattttctgggccgggcgtggtggctcacacctgttatcccaacactttgggaggccaaggtgagtggatcatctgaggtcaggagtttgagaccagcctggccaacctggtgaaaccccatctctactaaaaatacaaatattagctgggtgtggtggtgggcacctgtaatcctagctactccggaggctgaggcaggagaatcacttgaacctgggaggcggaggttatagtgacccaagattatgccattgtactccagcctgagagacagagtgagactccgtctcaaaaaaacgacaacaacaaaaaaacatatatatatattttctgagccaggcgcggcagctcacgcctgtaatcccagcactttgggagaccaaggcaggcggatcacgaggccaggagttcgagaccagcctggccaacatggtgataccccatctctactaaaaatacaaaaaattagctgggcgtggtggaggacacctgtaatcccagctatttgggaggctgaggcaggagaattgcttgaacccaggaggcggaggttgcagtgagctgagatcctgccactgaactccagcctgggtgatggagcgagactctgtcttaaaaataaaatagaataaaataaaataaaattttctagttgtgactactgaaaggacctagaaacaatgaagaccctgtagcaatgagcatccctagcacacagatcctggtttctactggcattccctgtaaaagacactgagtcgccaggcgcggtggctcacgcctgtaatcccagcactttgggaggccgaggcaggcggatcacaaggtcaggagatcgagaccatcctggctaacaaggtgaaaccctgtctctactaaaaatataaaaattagctgggcatggtggcgggcgcctgtagtcccagctactcgggaggctgaggcaggagaatggcatgaaccggggaggcagagcttgcagtgagccgagatcaagccactgcactcccgcctgggcgacagagcgagactccgtctcaaaaaaaaaaaaaaaaaagacaccaggtcttcttagaaaaacgactaatttcacttcaatgacaggtagatacaaggtgaatccgggatagcttgttgtgacaaaaaataaggaagcactccaagaccaaaggtgacatatcagaaggacacactaccaacttaaggaggcttatgctggccaaatttcagggtcagaacgactaatggtgagaacgaagtgtaaaataatgaataaattaaaatccatgtacaatatagtgatacagaaagtagcaaggaaacttatttgctaccactgaggtgaccacttcaccaattctttacgaagaaatttataatgaaaagcaaaaaagtaaacaccctaccttattagagatcaataaaggaaacatttgaaagtgcgtttacccccatactagtgaattccttaaaacaactgaaagtatcctaaatagaaaatattctaagggaacattaccagctaaaaccaaaacacgcttgcctttatagaaattaaatgaactacttcaaatctatttattactagaaaataagagagcgaggcgtagtggctcacacctgtaatcacagcactttgggagtccgaggcgggcggatcatgaggtcaggagatcgagaccatcctggctaacacagtgaaaccccgtctccaccaaaaatacaaaaaattagctgggcgtggtggtgggcgcatgtagtcccagctactgaggaggctgaggcaggagaatggtgtgaacccgggaagcagagcttgcagtgagccgagattgcgccactgcactccagcctgggcgacagagctagactccgtctcggggaaaaaaaaaaaaaaacaagagaaaataagttactaagctaaattactgtactgaacagtacatttttttttttttttttctgagacagagtctcactctgtcgcccaggctggagggcagtggagggacatcaactcactgcaacctctgcctcctgggttcaagtgattctcctggctcagcctcctaggtaactgggattacaggcacacactaatttttgtatttttagtagtagagatggggtttcaccatgttggccaagctggtcttgaactcctgacctcaagtgatccacccacctcagcctcccacagtgctgggattataggcatgagccaccgcacccggcctgtcagaatagtacaattttaaaagtgactattgccatatataataactatacatttatcagatttatatagtgtacatatataaatacacttatctgtgtgtgtgtgtgcgcatcaaagcatcacaagatacatccacctttgaagcaaaacactggaaaaaattaaaaactcagaaaaaaactttacaggccagcacagtagctcatgcctgtaatcctagcactttgggaggctgaggcaggtggatcacttgaagacaggagttcgagagtagcctggccaacatggtgaaaccccgtgtctactaaaaatacaaaattagccaggcatggtggtgtgcacctgtaataccagttactcaggaggctgaggcaggagaatcacttgaacccagaagcaaaggttgcagtgagccaagatggcgccactgccctccagcctaggcaacagagagagacttcctctcaaaacaaacaaacaaacaaacaaacaaacaactttacaaattaaaaagtagaaatttcaggcagggcactgtggctcacgcctgtaatcccagcactttgggaggccaaggccagcggatcacctgagatcaggagctccagaccagcttggccaacatgttgaaaccccatctttactaaaaatacaaaaattaggcaggcacagtggctcacgcctgtaatccccacactttgggaggccgaggcgggcagatcacgaggtctggaaatcgagacaatcctggctaacacagtgaaaccctgtctttactaaaaatacaaaaaattagccagctgtggtagtgggcgcctgtagtctcagctactcgggaggctgaggcaggagaatggcgtgaacctgggaggtggagcttgcagtgagccgagatcgcgccactgcactctatctagcctggcgacagacccgagactccgtctcaaaaaaaaaaaaaaaaagaaaaaaagaaaagaaagacttgcctataagtcataagctatattataagcttaatgctggacaatttttaaatgacttgtctgtaagtcatatccttgtacatgtagcaagctgtcacattatagaaaactgaacacatcaccttcacttttccatcagccgcaactttagatcactcattttcagttaagatacagatggtatatgttcaataatacagtgccacataaaaatttcactcaatccaaaaattcgaagtttttgcaatataggcaacaacacgctaaattaattgtacaacaactacagcactaaggtaaataacttgtactgggatacagaagttcaatatcaaagctactagcaacaccaatccacatagattctataaaagtttagtgtaattcgtcgggagcggtggctgaagcctgtaatcccagcactttgggaggcaaaggtgggcggatcacatggtcaggagttcgagaccagcctggccaatatggtgaaatcccacctctactaaaaaaaaactacaaaaattagccgggcgtggggcgggtgcctgtactcccagctactcgggaggctgaggcaggagaatcgctggaacccgggaggtagaggttacagtgagcagagattgcgccactgcactccagcctaggcgatagagcaagacttggtctcaaaaaaataaaaaagaaaaagaaagtttagtgtaattctcacttaagcggtcagcttcaatcaaaaaggaattaagatcttctcattttatttattgttgggaaaaaggagacagtactaataaccacctataatcaacattgtaaggaataacaattaaatatttactgtattaattgtcatcaaattaaaaacacagtgcctcttgtactagtttacaaaacaaaaacaaaaaagcatcatcactctaaagttgtcaccacttagtaatctgagatattttaattgcagctgcaatgtttgtgtttgttgcctgtgtatatgactcatatagaaaggttttcccaagactgctggatttttgagaatgcagaagccataactggggcatactgtgtgggaactgtcatgacagtgaatgaataaaaggggaaaagaacccatgacagaattttttttcaagtttttataaaaagcaagtcactcactaaaggcagactctgcagaataataggaaaggttggggaaaagccatccctgctccaagaagccttccttgactctcttggttggattcagtgcacttcttaacactacatagcacttaacgggtttccttgtctggctccccagccatactatatgcaacttcagaccaaaagctgtcttaaattagtacctacttcccaaaacacccgccatatggagggccctcagtaggtggttcataaataggaataatcaattttacatttaccttttattttacattttacaaagcactttcacgaacactatcttttctgatccacattaacaatcgtgggaagggctttatttaatcaaatggcttctggttttataaagagttaattcagggccgggcgcagtggctcaagcctgtaatcccagcactttgggaggccaaggcaggtggatcgcctgcggtcaggagttcaagaccagcctggccaacatagtgaaaccttgtctctactaaaaatacaaaaaattagctgggcatgatggcaggcacctgcaatcccagttactcaggaagctgaggcaggagaatcgcctgaaccggagaggtggaggttgcagtgagccgagatcattgcactccagcctgggaaacaagagcaaaactatgtctcaaaaaacaaacaaaaagagttaattcattgactaaaacaattctgaaatcacaaagataattacgtatttgttcatctttgagatagcttctccctgggacctcagtgttctcataaaactcagacgttttgttagcattttctttgcttgctctccataataggtaggactcaccctgctctgaatcttactcagggtttaaaccacataaagctgttattaaagacccctctagaaatcagacaagaagaagcatcctaagctattttttttctgatcctgttctttttgtaactaaggtaaggaattgcaaaggtcaaaatctggagagcaaatgatgtcatggatgtcatgaagttgcatcaatacctgatgatgatttagcataacagtgcaacatattatgccaagaagcataatgatgagccaccaggatgttttactgcattaatttcatgactctttattagcaaattgatatgcaaagtagctctccaattttctaccacagagaagctgctggttcagatttacatctttagcaaagacactaagaaaatcgacaaatttctatggaaaagtctttgatttaaaaatagaaaaggaggctgggcacggtggctcaagcctggggtggggcagggtatcgcttgagaccaggagtttgagatcagcctgggcaacatcggtgaaaccccgtctctactaaaattacaaaaaaaaaaaaaaaaaaaaaaaaattagcgggcgtggtggcgcacacctgtaatcccagctactcaggaagctgaggcaggagaatcgcttaaacccaggggatggagattgcagagagccgagactgtgctactgcactccagcctggatgacagagtgagaaactgcaaaaaaaaaaaaaaaaagaaagaaagaaagaaagaaagaaagaaagaaagaaaatggtcaaataataacctaaacagttgtcattttaacaatgaaaagctttttaagatacgcaacatgcctatggatcaatgtagattgaatcatctatttatactggcttgtcaaaagcaaacagttactgggtataaaatgacaacatacaatagaaaagacacccaatcagattacacacgtgaatacactcaaagttagcaatttaacacagcatcactaatggccataagatatacagacttaattctaaatattcaattctaaatgatggtacttcccccaaattttccttgcctctttaaatccatgatgtcatcattcttaagcagaagtaaagccaatttgttacaaaagatattttggtgtgtccaagcaaaagcaatcgcctcaacaattctgcatagcacaagttcagtgaagccatcattcctcaagaaagagaccacaaggcttcaaaccgacttccctacatgacagaaacacaatcgaagtctcccaattagcatttaaacagcaataaaagttgttctcaaaaaggaacaacatagtttcaacgtcggggccagcaactgccagcaagtaaaactggtaatgtgtcagaatcttcatctagatcgatcagaatcccaccacagaaaaatccagactctggcaattaagaaatgaggcttttattttcctaacagaaatcgggagatttaacagacaaagcaattggttattctgaatcttaacaaaccgaaggtttcaaacgaactcagcgctgaagttactctgcagcgaccatcaagatctcacaatcgttttctcttcgcttacaaattcgttcccaccctccaccgttccctttgcacacacaattctcgccaagagaagccttccacagtcacagcatggattgctgtctcaagcaaggagatccgcagttcccatttctctaagggaacactcaacaagctaggggataggaaaggccttttgtgttttatttaacgtaaaccaattccaaaattatccctttgcagctgcaggttcagagatgctagcccccagccgcagccccaattttgatgggcacccgacccccgactcctctctcgcaaaggagtgaaatgttcggaggagcgatgaaagattacctgacaccctaaagccatccttgcccgggccacacaccccttcactgcccgggtgaggggacgagaaccaccctgctgaggagagggggtgggttcgctcccaacccaagggctggctggaaaggagctgtcctcctcctcgcctcactcgaggacggcgatagcaagtcaccctgcccaaccaggaccgacccccgcgtgggatacggggcctgcgtcagaccccgggcgcccgctgccccttgccagtcccgggcataaagggcagaaggcgccggctcccctctgcggcccggggaggaggagaggcctcacctggcccagcccgctccacgctctcgggttcgctccgctggcgacggtaatgagggagccagggacagggccagagcagaggcgctctgcctcaggccgcgacagccgtgctcggggctcctcacagctggcgggaccccgagccgcccggagccgccatcttcctccactcaaacgccgccgccgccgcagctgctgctgctcaggccgggagaagacagcgcagagcgcgcatgcgccggggcgggcgcggcggacgcgcgcgcactcacgtcagcgcggcgggatggcgaggggcggccagggggcggcgcagtgttgagaaaggccgtggtcacaggccgaggttctgtggagggtggaatgcgctcgggggagctaggcctccgcacccgccttcgccgcgtctctagcgtcgacctgatagccgcacccaccctccgctgcactgtctggggcaactgggtggttttcccggtggtttgagactaacatttagccaggaattaactcacttctaccccgagggcccgatgagcagagagggctgtggcggatgtgagtgctcttggatatcgccaaggggagggaaactgtgcttgaggtgtgcaggagaagtcttcccttaaccgtagcctcgtagcaaccactgtgagttcttactagctccacttttcagatgaggaaactgaggcacagaaaacgatcacttatttgcccggagtcacacacctatcagtggaggtggggcggcgcgggaaagaggatttaaactcaggcttgtctggttcccaagctcctttacttcctactagctaggttataggatccagcaaagtcccccttctcaagggagcaacctggtgtgtaggtgagaaccttcatgagcccagccctacagcatgtggtctaaggaaatgccagatacagagtcaaaggcttcagtctaaactctgtaagccaaaaaaacaaaacaaaacaaaacaaaaaactaagcccccaccccccccccaacaccaaaccatctgaacggacttcctcctaggccagggcagtctaaaatgtaaccaacctgagagactggttcaggccatgacgggaagcaggacatgagacatgcctcattacatccttcagcattgacatcaacacaacagaccttaagactggtaagaaacatttacaatctgttctctctggagcccacctgccacttggaggcttcacgtgcgtgataaaactttggtgtccacaatcccttatcataacccagacattcatttctattgataataacttttttttttttgagacagggtctaactctgttgcccaggctggagtccagtgatgagttcttggttcgctgcaacctctgtctttcaggctcaagctatcctcctaccttagcctcctgagtaactgggactacaggcgggcaccaccatgcctggctaatttttccattttttttgtagacacagggtttcgccatgttgtccactctcatctcaaactcctgagctcaagtaatccacttgcctcggcctcccaaaatgcttggattacaggcgtgtgccaccgcaccaggcctattgataataactatttcaactcattgccaatcagaaaatgtttaaatctgcctataatgtggaagcccccacttcaagtttccggtctttctgcaccgaaccaatgtagtttttatttatttatttacttatttttatttatttgtttatttttttgagactgagtcttgctctgtcgcccagactagagtgcagtggcaccatctccgctcactgcaacttccgcctcctgggttcaaccgattctcctgcctcagcctcccgagtagctgggattacaggcgcccgccaccgtgcccagctaatttttgtattttcagtagaaaatacaaaattcagtagaaaatacggggtttcaccatcttggacaggctggtctcaaactcctgaactcgtgatccactcacctcggccttccaaagttctgggattacaggtgtgagccacggcgcctggcctttttatgtatttattgagacagggtctcactcttcgcccaggctggagtgcagtggtgtgatctccactcactgcaacctctgcctcccaggtccaaacgattctcgtgcctcaacctcctgagtagctgggattacagacatgtgccaccacacccagctaatttttgtatttttagtaaagacggggtttcaccatgttggccaggctggtctcgaactcttgcctcagttgatccacccgcctcggcctcccaaagtgctgggattacaggcatacgcccctgcacctggccctgtattaatatatcttaaatgtatttgattgatgtctcatgtctctctaaaatgtataaaaccaagctgcttcccaaccaccttgggcacatgttctcaggatctcccaagggctgtgtcatgggccatggtcactcatatttggcttagaataaatctcttcaaatattttacaaagtttcctcctaggaaatctcatggggcatagggctgggccagaagccaagttcccctcaagttggagggcaaggcctctttgagcagacttgggtcacccttacccatagagagctgtatgagccagaggcggtggtgcatacttgtcagcccagcactttgggaagccaagaggggaggatcgcttgagctcaggaatgcaaaaccatcctgggcaccatagcaagaccccatccctacaaaaagttgaaaaattagctggacatggtggcatgtgtacctgtagttctagctacttgggagacagaggcagagggttgcttgagctcaggagttggaggttgcagtgagctatcatcacctcactgcacgccagcctgggtgatagagggaacccatctcaaataaataaatagaaagcagtatattcttacgttcttcaaacctgaataatgcaaagtcccctagggatacactcagggaatcccagtgggagaaacattgatttaagaaaatcatgttttggccaggcgcggcggctcacgcctataatcccagcactttgggaggacgaggcaggcggatcacctgaggtcgggagttcgagaccagcctgaccaacattgagaaaccctatcactactaaaaaaaaaaatacaaaattaaccaggcgtggtggcacatgcctgtaatcccagctactcgggaggctaaggcaggagaattgcttgaacccgggaggtggaggttgtggtgagccgagatcgcatcattgcactccagcctgggcaacaagagcgatactccctctcaaaaaaaaaaaaagaaagaaaagaaaagataaagaaaatcaagtctttcaactaggaaattttactgcaaaagagaaattgggcaattataactggtaaaggaaatatttttaaatctggtttttaaatctagtttttaaatcatgtcattaaaaacctcaagcttaaaaattactagaactgagccgggtacggtggctcacacctgtaatcttagcactttgggaggccgaggcaggcagattgtctgagctcaggagttcgagaccaccatgggaacaacatgctgaaaccctgtctctactaaagtacaaaaaattagccaggcttggtggtacacacctgtaatcccagctactcgggaggtggaggcaggagaattgcttgaacccaggaggtgaaggttgcagtgagctgagattgtgccactgcactccagcctgggccacggagcgagactgtctcaaaaaaaaaaaaaaaaaattactagaacttgtgaccaactccactcttccccctccaaatatcctgtagagctcaatattggaaacactggaccagctattaaatgctactttttttttttttttgaggaaggaagtttccaaccgggctcaatcaattcttccacctcagcctccagagtagcttgcatagtcccagatacttgggaggctgaggtaggaggattgattgagccagggtgtttgaggttgcagtgagctataatcactccactccagcctggtgtgacagagcgagactctgtctcaaaaaaaaagtaaaagtaacaaaaaaaagtaaaaaaaaaatcctagcactttcgtaggccaagacaggtggatcacttgaggtcaggcgttcaagaccagcctggccaacatggtaagaccccgtctctactaaaaatacaaaaattagccaggaatggtggcatgtgcctgtaatcccagctactcgggaggctgaggcacaagaatcacttgaaactggaaggtggaggttgcagtgagctgagatcatgccactgcactccagcgtgggtgacagagtgagactctgtctccaaaaaaaaaaaaataagtaaaagtaaaaatgcaggttccatggccagttgcagtgttgcacgctggtaatcccaaccctttcagtggctgacatgggaggctgacttgaggccaggagttgagatcaacctgagcgagatagcaagaccccatctctacaaaaataaattaaaatgcaggttccagggcccacctcaaacaatggcctcagacttttctgaaagctcctcagggattctgttgagcagtcagggttggaactgctggaccatgttagaatacgttcaaatacagaatcacttcaccctgaatcttcttactcaaggacagcagggatttttgtctgttttccaccagcacctgacatagagatgcacatagtagggactcactaaatatttgttgaatgaatgaacttggaatttggcaactaagagggcatttgggaaacaaatatttagtgagcacctactatgtgccagaccatgtgatacgtatggtcatatatatatacaatattaatatatatatttataaatatatacaaattttttttttttgagacggagtctcactgtgtctcccaggctggagtgcagtggcatgatctcggctcactgcaagctccgcctctggggttcacgccattctcctgcctcagcctcccgagtagctgggactacaggtgcctgccaccacgcccagctaattttttgtatttttagtagagacatggtttaaccgtgttagccaggatggtctcgatctcctgacctcatgatccacccaccttggcctcccaaagtgctgggattacaggcatgagccactgcacctggccataatttttttttttttttttttgaggcagagtcttgcttctgttgcctaggctagagtgcagtggcacaatctctgctcactgcaacctccgcttcctgggttcaagtgattctcgtgcctcagcctcttgcgtagctggaattactggtgcgtgccaccatacccagctaatttttgtatttttagtagagatggggttttgccatgttgccctggctggtcttgaactcctgacctcaggtgatccacccacttcggcctctcaaagtgctgggattacaggcatgagccactgtgcccggccatggtcatatatattttttaatgaaacataaggtctctgcccttgtggagggccctactatctactgagagagataaccaatacacaaagactgtagacaagatagaagtataaattgtgataaggacaaaagtattaaactctaataataatcacaattgctatttattgtttacatttattatgtaccgaactctgctaagtaggcgtcattattgtgcctattttaaagatgacgaaactgagctacatagtggctggaatatcgggggaagactggagattacattataggtcatgaagaactgggaacggggaggttatactctataattaaaatggtttttcagaatagtctctctgcagtgtgaaggctgattgggacatgattaaagacaggggataaggctagaatgaaaggggtggttggagtctctctaatacgtttaaataaggtactttcctccagagtctgtcccaataatcaatcacagtcacgcaccacataacagtggtcaatggcaaaccacatgtacaatggtggtcacataagattataataccatatttttaccgtaccttttctatctatatgttttgttttgtttttctcaagacagagtcttgctctgtcgccatgctggagtgctatggcgtgatctcggctcactgcaacctccccctcccgggttcaagcgattctcctgcctcagcctcccaagtagctgggattacaggtgtgtgccaccacgcccagctaattttttgtattttttggttttttattttatttatttatttatttatttatttatttatttatttatttatctgagacagagtcttgccctatcagccaggctggagtgcaatggcacaatctcggctcactgcaacctctgcctcctgggttcaagcgattctactgccttagcctcccaagtagctggggttacaggcacgcatcaccatgcccagctaatgttttgtgtctttagtagagacagggtttcaccacgttggtcaggctgatctccaacttctgacctcaggtgatccacccgcctcagcctcccaaagtgctgggattacaggcgtgagccactgcgcccagccaattactgtatttttagtagagacaggatttctccatgttggccaggctggtcttgaactcctgacctcaggtgatccgcccaccttgccttggcctcccaaggtgctgaaattgtgctgggattacaggtgtgagccactgtgtacagcccagaacataatttattcttttgttttctttttttttttgagatggagtctccctctgtcgcccaggctggagtgcagtggcacaatctcggctcactgcaagctccacctcctgggttcatgccattctcctgcctcagcctcctgagggactacaggtgcgtgccaccacgactggctgtttttgtattttgagtagagatggggtttcaccatgttagccaggatggtctcgatctcctgacctcgtgatccgcccgcctcagcctcccaaagtgctaggattacagacatgagccaccacgcccggcccaatttattgtttttttgagacagagtctcgctctgtctttcaggctggagtgcagtggcatgatctcggctcactgcaacctcagcctcccaggttccggccattctcctacctcagcctccaagtagctgggatttacaggtatgcgccaccacgcctggctaatttttgtatttttagtagagacagggtttcacggcgttggccaggctggtctcgaactcttgacatcaggtgatctgcctgcctcggcctcccagagtggtgggattaaaggcatgagccaccacacctggccagaacatagtttattcttaaagggttggggtgcatgacttaacccttgcttggtatgaccttatgtcctgtttataattggcatcttggtcgcacgcggtggctcacgtctgtaatcccagcattttgggaggttgaggcaggaggatcactagctcaggagtttgagaccagcatggccaacatggtgaaaccccatctctactcaaaatacaaaaattagccgggcgtggtgttgccagcctgtaatcccaactactcaggaggctgaggcaggagcatctcttgaacctgggaagtggaggttgcagtgagccgagatcgagccactgcactccagcctgggcaacagagagagactgtgtctcaaaaaaaaaaaaaaaaaagcatcttattaccacaaagcatttgttgtgtcagtcttatgatctctattttagcattaatgctggtcaattgttgtgtctaaactgtgaaagggatagggtataaccaagtgtgtctgacttcctgttccatcatggcttctctggggtcccctgtaccaaaagggtgtccatttagtccgttggaaggtttaggattttatttttagttctcatgtgagatcactcagtatcagtgcatttaggacaatataaatgttattaacagttgcattctattcttttataggaatgtaccatagtcttttaaaacaaattctctagcgatgaacatttaatttgtttccagtcttttttgattatagacaaaatagcaatggatatccttaggtatgcacattttctttttgtttgtttgtttgtttgttttgagactgagtctggctctatcacccgggctggagttcagtggcatgatctcggctcactgcaacctctgtctccaggctttatgcgattctcctgcctcggcctcctgtgtacctgggattacaggtgcgtgccaccacgcccagctaatttttgtatttttatttttatttatttatttatttttgagatggtgtttcgctcttgttgcccaggctggagtgcaatggagcgatcttggctcactgcaacctccatctccagggttcaagcaattctcctgccccagcctcccgagtagctggggttacaggcgcctgctgccacgcccagctaattttatgtatttttagtagagatagggtttcactatgttggccaggctggtcaccaactcctggcctcaggcaatccacccgccttggcctcccaaagtgctgggattacaggcatgagccaccgtgcccggccttatttttatttttttattttttattttttttatttttattttttgagatggagtctgttacccaggctagcgcagtggctttatcttggctcactgcaacctccacctgccaggttcaagcagttctcctgcctcagcctcctgagtagctgggattacaggtgcgcatcaccatgcccggctaactttttgtatttttagtagagatgaggtttcaccatgctggccaggctgatcttgaactcctgacctcatgatctgcctgcctcagccttccaaagtgctgggattacagacatgagccactgcaccagacctaatttttgtatttttagtaggggtgggatttcaccatgttggccaggctggtctcgaactcttgacctcaggtgatccacctgccttggcctcccaaagtgccgggattacaggtgtgagccaccatgcccagcctgcacattttcaatattggtaagttgccatttactcatcacaactatctacctagcttcagcttgtgcgtcagatagaaagttatctcggccgggcgaggtggctcacgcctgtaatcccagcactttgggaggccgaggcgggcagatcacctgaggtcgggagttcgagaccagcctgaccaacatggagaaactccatttctactaaaaatacaaaattagccgggtatggtggcgcatgcctgtaatcccagctactcgggaggctgaggcaggagaatcgcttgaacccgcgaggcggaggttgtggtgagctgagatcatgccattgcactccaacctgggcaacaagagcgaaaatttgtcaaaaaaaaaaaaaaaaaaaaaaaagctgggcgcagtggctcatggctgtaatcctagcactttgggaggctgacgcgggcagatcacaaggtcaggactttgagaccagcctggccaatatggtgaaatcccgtctttactaaaaatacaaaaattagccaggcgtggtggcacgtgcctgtagtcccagctactcaggaggctgaggcagaagaattgcttgaacctgggaggcagaggttgcagtgagctgagatcacgccattgcactccagcgtgggcaacagagcaagacaagacaccgtctcaaaaaaaaaaaaaaaaaaaaagtggactctctgtctcaggaaaaaaaaaagtcacctgaggtcaggagtttgagaccagcctggccaagatggagaaactgtctccactaataatacaatacaccgggctgggcacggtggctcaaacctgtaatcccagcacttcgggaggccgaggcgggtggatcacctgaggttaggaatttgagaccagcctggccagcatggtgatacccggtctctactaaaaatacaaaaattagccaggcttggtggcaggcgcctgtaatcctagctacttgggaagctgaggcaggagaatcgcttgaacccgggaggcagagcttgtggtgagccgagatcacaccattgcactccagcctgggcaacaaagcaagattctgtcaaaaaaaaaaaattagctgggtatggtggcccaggcctctaatctcagctactcagaaggctgaggcaggagaatcgcttgaatccggaggatacagtgagccaagatcacgccattgcactccaacctgggtgacaagagagaatctccatctccaaaaaaaaaaaaaaaatgcaaaaacttagctgggtgtggtggcacacacctatagtcccagctactcagtactcaggaggctgaagcaggagggtcacttgtgcttggaaggtggaggttgcagtgagccatgattgtgccactgtactccagcctggtgaccgagtgagagcagaaagagtgagagagagagagaaagactcatgctttagggcctctgacaatacctgtgtattgtgtgcctcaactttttttttttttttgagacaaagtctcaccctatcggccagggtggagtgcaatggcatgatctcagctcactgcaacctccgcctcccaggttcaagcgattctcctgcctcagcctccctagtagctgagactacaggcgcgtgccatcacgcccagctaatttttgaatttttagtagagaaggggtttcaccacgttcaggatggtcttgatcttttgacctcatcttccacctgcctcggcctctcaaagtgctgggattacaggcgtgagtcacggtgccaggccgccactgcctcaactttttgggcttatccctggaagaagaaactgccactactttttcaattttagagctaatttggttccatccctgattttacagatgaggaatcagactgagagagaagagacttgcccaaggtcacaaggggtctatgtgattaactaagactgacctcctggttacccattttgtggaacaaaaactatttcatttgcagcattttcagatgatttccaaggtctccatctttcttgtctccttgaaaatgcagtcccagaaatgcacaactaatgcttttgttaagggtcgttgcccaatatgctaaattgtaagaaaccatctccctctgctggtaatatggcataacgacaaagcttaaatataggagtcacttgcatttaggaaaaactattgctccagaacgaggttatgtctgacagtttctgtatactttttttttttttagacggactcttgctctgtcgcccaggctggagtgcagtggtgcgatctcggctcactgcaagctctgcctcccaggttcacaccattctcctgcctcagcctcccgagtagctgggactacaggcgcccaccaccacacacggctaatttttttttttttttgtatttttagtagagacggggtttcaccgtgttagccaggatggtctcaatctcctgacctcgtgatctgcccgccttggcctcccaaagtgctgggatttacaggcgtgagccaccgcgcccagccccgtctgacagtttcaaccactttgctgttgccaagactcagtcaggataatttacttcaacgaatgggttcacagtagaatgtattccaagtaaatataatctcacagagtgaataagccaaaaatccatgaaattggtgaactcaacagaattactgagtttttgtgtggtttttttttttggtttttgtttgtttgtttgttttttgagatggaatctcactgtcacccaggctggagtgcagtggcatgatctcggctcactggaacctccacctcccgggttcaagcgattctcctgcctctgcctcctgagtagctgggattacaggcatgcgccaccacgcctggctaatttttgtatttttagtagagacggggtttcaccatgttggtcgggctggtctacgaactcctgacctcgtgatccgcctgccttggcctcccaaagtgctgggattacaggcgtgagccactgcgctcggccgagaattacttgagttttagagacttaaaagctgctagtggaatatccatgtggagatggcaataagaagcctagctgtaaaaatcagaatcagaaacaccaggtcagttcacagctagaagtcaactttggcagtcttcagcatacagtgggtggcttataccatgaacatctaggtaagaacagtggactgaggacagaccctggaaatgaacaatatttcagagtcaggaagttgtgaaaccagagaattagtaagcatatcacttaagcttctaaataaagaccagtaacatttaacacatggttgcagtttatgatgataatcattaagaatacaaataacaggacgggcagagtggttcacacctgtaatcccaacactttgggagattgaggcaggcagatcatctgaggttaggggttccagaccagtctggccaacatggtgaaacctggcctctactaaaaatacaaaaattagctgggcatagtggcaagcacctatagtctcagctactcgggaggctgaggcaggagaatcacatgaacccaggaggcagaggctgcaatgagccaagattgcgccactgcactccagcctgggcgacagtgagactatgtctaaaaaaaaaaaaaaaagaatacaaattatgaaatttcacagcaggaaggttttacttcagaaagattaatggcatactaaaaatacaagaaaaaacacattccaagtcagataacttggttatagcagccaaatgcaacactactgaatgacatgtatttaaaactgagagaaaaacaggaacatgtcagtaagaatataaacacatggtgtttgcttatctccctgcctttttttttttttttgagacagagtctcgctttgttgcccaggctggagtgcaatggcgcaatcttggctcactgcaacctctgcctcctgggttcaagcaactctcctgcctcagcttcccaagtagctgggattacaggtgcttgccaccacatccggctaatttttgtatctttagtagagatggggtttcaccatgttgaccaggctagtcttgaactcctgacctcaactgattcgcccacctcagcctcccacagtgttgggattataggcgtgagccaccgcgcctggcatctccctgtccttatattttaagaaaggatgattacagaagtgacaattataaatcttcctcgggcagacaagacactcccataatgataatagctaacccttaggactcttactatgggtcaggcactgttctaggcatttcagcatagtaactggttaaattcttacaatctacttttgaagtagctatctctaatgtatacacttggggaactgagacatagaatccttatgtaacttgcgttaagatcacacagcttttttttttttttttagtagagatgggcttttgcctcgttgcccaggctggtctcaaactgcagggctcaagcgatccccccgcctcacccttccaaagtgctgggattataggcgtgagccaccatgcccggccacataaataacttttttttgagatagagttttgctcttgttgtccaggctggagtgcaatggcgcaatcttggctcactgcaacctccgcctcccaggctcaagcgatcttcccgcctcagcctcccgagtaggtgggattacaggcatgtgccaccatgcccagctaattttgcattttaagtagagacggggtttctccgtgttggtcaggctggtctcgaactcttgacctcaggtgatctgcccaccttggcctcccaaagtgggattacaggtgtgagccactacgcctgccctgacataaataattttttttttttttgagacagagcctcactctgtcggccaggctggagtgcagtggcatgatctcggctcactgcaacctccacctccctggctcaagcagttctcctgcctcagcctccggagtagctgggattataggcgtgtgccaccatgcccagctaatttttgtatttgtagtagagacggggtttcaccatgttggccaggctggtcttgaactcctgacctcaggtaatccgcctgtctcggcctcccaaagtgctgggattacaggcgtgagccaccgcgcctggccagtaatttttagaggtaatactaacgtatttatctaccattaaagacccaggagaacttagtagctgggaatcccactggttctcccaactgaggtgcaatattatctttaccgtctttaccttacggtagcggatatagtgttaataaatgattagaatactgctttatgagcaggaaatactgtaatgattttcaccctatcagaaataataaaatgttttctgcatcagcagatatttttcatcatttgttggtgtttaaaaatgttttcagaattctgaagataccattatctgtagtttaggaaaactacgactcactttaaaagaaaaaaagttttctttaattgcctgcccttagaaaagatggttccacagaacacacttccggtactcgagatgaggacttcccttgaacgcccattctgtaagacagataacgcgttggcccttaagaaagatggcatctttccgccttctctgcccccttccaagatggctgccctaatgtacacttgggaccttgcctggcgcctcttccgggcttggcagcgggcggggtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggtaaggaggagccgccgtcccatggcagggccgggcgagacctggcgtgaggggagcctccggggagcgggtctggagatagttctccccaaggaagggccccatacgccgggctgggggtggtggagaggcccccagttcctgagcgccgtgaaggcctcttaaaggggccgcgatccatttctctcctttcctttgcctggtgcgcctccctccgcccactaacgcgcgcgtcacccggggcgccccacccgccacccggggcctcctttcctgaccccccgcgcccacttgctggccgtgggcctctgtgactctttccgatgagccttgtggcccgaggcaccattttaaagttcttgtgctctgaccgggacggacacaccatgtgggtggtggtggggcttgcgcggaccaaggaggcatgtccggcttcgcaggaaagcgggaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggtgtgatatgtaaaacagccacattcttgggagaggagtggggagatggaccgttcgacttgtttttggagtttttgtttgcctccagaaactgtaggaaaatagtttatctcaaagaggatctgtcaattctcttagatttgtgaataatttggtcttttcagagtttgtctgtggtgacccttgtgaatatggggagatgctttttttgtctccccgtgttcgcgtctgttcaatgctggctgcactgacatccaccttaaaggtttacgtgtgcgaggagtcgagcgtaccagggtagagtaggcgctgggttttttttcctaagcgctttttgggggtgcttatgagctctggaagaggccgggaaattgaccctggcagcagtcagtgggtgtatctagctctacgggaatgttgaaacttggctttgaagttttttccgctggttcagcatttctctcaacggttgtttatgtttttccatttagcataattgagaatttgaaggattcgttcgttcagaggatatttagtagagttcttaatgtgacaaccatctttcttgagttttggcttaagaaagttaaagattttatagggagtaacaggtgtcagttggctccttgttcattcaaccagcatttttgagtgtctgctatatgctaggcagtgtgcttatcagtgactttgtgccagaaaatgcaacattttcggtacaggcgtttattgcctaccactaatctgagtgaatcatccagacatccctataaaaaagcttggcttacaactttaatatcatgcaaatgatacgtttcttgggcatcttggcctttctttggttttcctcacctgtttcaaagggtcataaatccctcatgttagagaagttggaggcaaatgaacaaaaatgaataggattcagcagaaattggggcttactttagtttttcagaatgggtaagtcaattagaaatagctagtacagtcccccatttaacagctgaataagcctagagatgtgagatttagagacttaggtctttctgacgcttgtcgcgtgttctttcttttttcttttggttcccaagttttattgaaaaacttatacaaaatattccagataaatgaaatttaatcctcatcttcctcctctttgtcctggttaatctggaagtaacataatttgtagctatctttgctgttagtaactaggagcaaccaatcacgtaaattattcttcatatatgttttggtgagatatttgaaataccttttggagaaaggcacctcggatgtcacgttgatcttgctcttactcctttcaatggtcgccatccctccaccaaggttctcagcttttccgttcactttgatcctttcttgcaaaaactgctcaaaattggcagcatccatgattccatcttctacggggtgagtgcattcaagagtgaacttcagaacctgcttcttttttttgccccccttcaccacaggctttttcacagaagccatggcagcagcggaggcagaaagccagagttctttctgctatcccttactttagtaatatcctttaaaaatgtaccgcggccaggtgctgtggctcacgcctgtaatcccagcactgtgggaggctgaggtgggtggataacctgaggttaggagttccagaccagcctggccaacatggtgaaaccccatctctactaaaaatacaaaaattagctggaccctatggtacatacctgtaatcctagctacttgggaggctgagccaggagaattgcttgaacctaggaggcggaggttgcagtgagccgagatcatgccattgcactccagcctgggcaacaagagtgaaactccatcaaaaaaaaaaacaaaaaaaaaaaactacagaggtggaacacaaaccttgccttattgacatcatgaacacttctgccaaaatgcaggttctctaatatattttatttaattgaatccttgaaacaacctgttgaggcattgtcccccttttatagacaaggaaacggaggtttcgagagtaacctgttttgcgcaagatcacacagctgggggaagctgggatttgatcccaagcatgtctgacttcaaggctgggctttttttctctagcattttgctgctacctctctacctggggacatgtggaaaatttgggaattgggtgttctttcttttccttttttttttttttgtttgagagaaggtcttactccattgcccaggctggagtgcagtggctcaatctcatctcactgcaacctctacctcccaggttcaagcgattctcgtgcctcagcctcccgagtagctgggattacaaggcgcatgctaccacgcccagctaatttttgtatttttagtagagacggggtttcaccatgttggccacgctgatctcgaactcctggcctcaagtgatcctcctgccttaggctcccaaagtgctgggattacaggcatgagccgctgcacctggcctttttttttttaattttttttttattttttgagatgagattgcccaggctgggcctcccagtagattataggcatgtgccactatgcctggcagctttcattaaaaaaaaaaatatttatttattttagatacagggtctcatttggtttcccaggctgaagtgcagtggcataatcatagcttactgcaaccttgaattcttgggctctagcagtcctcctgcctcagcctcccagagttctgggattataggcatgagccactgccctcagccagctttcatttttaatagtttgtctgggcttatatttgaacgctgtcttgaatttgattcccttttcaaatttcacaaaggttcttgtaaatatgcacttttgaaagaggggagccagggagatgttatgtccacatcactgggaaaccaatggactgcaggctatacatgtctttcatatataggcaattgcgtaaaagtcttggcttcaggttatcccctcttcctactggtaatgagctttgaataccctactccaaaacagcaaaaactgggtgaagactaataacctaaatgggaaaattgaaactacacaaaaatccagcggcagttctaatccttggaagtaaaggattttggagatccctgccctccaacaccacaagaaaatttttgtcttttttctttgagacagggtcttgctctgttgcccaggctggggtgcagtggggaacactcactgcagtctcaggcaatttctgtctcaggcaatctccacccgcctcagcctcccaaggtgctgggattacaggcatgagccatcatgcccagccaaaaattttttgacatcatgtagaatttctcccctcccctcccctccctctgctcccatccctctgctcccccctctcccttccttttttttcctttttttttttccccttttttttttttcccgagatggagtcttgctctgtcgcccaggctggagtgcagtggcgcaatctcggctcattgcaagctccgcctcccgggttcacaccattctcctgcctcagcctcccgagtagctgggactacaggcacccaccaccacgcctggctaattttttgtatttttagtagagatggggtttcactgtgttagccaggatggtctcgatctcctgacctcgtgatccgcccgcctcggcctcccaaagtgctgggattacaggcgtgagctgctgcgcctggcccctttcttaagacagaagggtcttgctctgttgccaaggttggagtgcagtggtcggaatacagctcactgcagcctcagcctcctgagtagctgggcccacaggcgtgtaccactatgtgcctggctaatttaaaaagaaaatttttttgtagagacagggtcttgccatattgcccagactggaagaatttttgtgtgtgtgagtcatctgaggtcattgtttcctgtatagcttccgaattcttagtatcaagtcctattgtgtcatttggagaaagactgactttgagaagtccctcacatattctgtgaatagactttttgcttttagttagtatggcaaacacttttttctttttctttttcttttttttttgagacagggtttcgtcctatatccccaattgtttaagacaatcaataaaatatgccaggcgtggtggctcacgcctgtaatcccaacactttgggaggctgaggcgggcagatcacctgaggtcacgagttcaagaccagcgtggccaacatggtgaaaccccgtctctattaaaaatacaaaaatgagcttggcatggtggcaggtgcctgtaatcccagctactccggaggctgaggcaggagaatctcttgaacctgggaggcagaggttgcagtgagcagagatcgcaccactgcattccagcctgggtgacagagtgagactctgtctcaaaaaaaaagagttcatagtgttggtaatgagctaacccagctaggggaaggcagcagatgatataaaaatgtaattggaccagtggttattataaagcactgacaacctctctgatttccctgtatcttgcaagtttccttttattctttttctccaggtcaaggcatgcagctagtgggaagaaaatgcatcttgaataagttaaaggatgactggtgttctggattaagaattgaaatttatgtttactttctacccccatgagccagttatccaaacattgccccatcagtgatgctggatggtgtatgagtccataggaaggtgtcattaaacattaaataactattgcataccaggcatggaggccctgtttagtgggggagtcagacaggtccggcagcaccttcaggaagaggcataagtggggtaccatggctggatcagagaaagtcttgtaaagaagacgatgcctaagttaagatttgaaagatcagttgaattaagcagtggtaagtctgggagaggcaggtagagtgtagggccaaagcaggcatggatgaggaggccgagagacaaatacacagcattgggagggctacaagtatttccttctggctgaaggggagagggttggcagggttgagtggaaagagatgagaccacagaggtatgtaggggccagattgggaaaggcttccttgtacttggttctggaagcttgaactttgtcctgaaagtgcaaggagctttgaagttttttttttttttttaagcagaagagtgatatagctagatttatttatttatgttttaaattttttgccggacacgatggctcatgcctgtaatgccagcactttgggaggctgaggcaggtggatcacctgaggtcaggagttcgagaccagcttgaccaacatggagaaaccctgtctctactaaaaatacaaaattagccaggtgtggtggtgcctgcttgtaatcccagctactcgggaggccaaggcaggagaatcgcttgaacctgggaggtggaggttgcggtgagccgagattgcaccattgcactccagcctgggcaacaagagtggaactccgtctcaaaaaaaaaaaaaaaacaaaacacgttttttttttttgagacagggtctcactctgtcacccaggctgagcgcagtggtgcaatgatgacttactgctgtctcgacctcccaggctcaagtgatcctcccacttcagcctcaacctcccgagtagctgggactacaggcatgcgccaccacacctgactatttttgatttttttgtagagacagggtctcaccatgttgcccatgttggtctcgaatgcctgaacataagtgatcctcccgtttcagcctcccggagtgctgggattgcaggcgtgagccaccacacccggcccatagttagattaaattcaggagatcagaactttgattttcttctctttctttggagaagaggccattctccccaaagtgtgactgccgcttcactctggggtccccaatgctttgtgtagctgctgtcattttggaacatgtacaacaaaacaacaaaaaaaggctatgggtagtgggaaaaaagagatcaattagtttggggctatctggtgctgatttctttatgtctgtccctgcagtaaaaagaaggcatttaagatttgtggtatcacagaaagcacagttccagatacaccatgcctaaaggggccacctctcagttggtgctagtctttctggaaaggttgagccttatggactgtgatgtcctcagaaggggctttctgtgaagcagttgggcagtttaggcatgattctgctgagcagtctgtccctgggactctggaaaaaggttggtttcactgtggcttcaaagaaaggaggataatgagcttttcactagtaacttctcagcccttttttcattggctgcatgggagggcctgttcccagcgtgctctgggtatcaagagagctgccatggttgccgtgggctagaaattccagcaatcacaggccttcttgtttttacttctatgacaggagaggatttagtgcgtctttctaaaactgttggtgcagtcctgcagagaaaagtcacagttgtctaggtctgatgactgaaaacattccaggggccagccctttccagtttccacctctccactgctgttggccccgacagctagcatcagtttctggctgtatcaggtagctagcctctacaaggtgtgttctgtcaggaaaactactgacctgttggtttcctaggagaaggttgagtttagctacttaaatctgtggccaaagtataaaataaaataaaaaaattttaatgtagtatccatagagatttctcttcttgagtgtttttgttttgttttgtttttttgagacggagtctagctctgtcgccgaggctggagtgcagtggcgcaatctcagctcgctgcaacctctgcctcccgggttcgagcgattctcctgcctcagcctcccaagtagctgggattacaggtgctcgccactacacccagccaatttttgtatttttagtagagatggggtttcactgtgttggctaggccggtctcaaactcgtgacctcgtgatccgcccgcctcggcctcccaaaatgctgggattacaagcgtgagccaccacgcctggcctttgagtgtttttcttaaaaccgtttgctcctaccaagcatccttctctttaacatctagctctgtgcaggatattaaggtaaaaccatgccccacagaaattagcaacaaaccccaatagtctgtatggagacagataatttttttttcttttttttgagaaggagtttctctctgtcacccaggctagagtgcagtggcgcaatttctgctcactgaacctctgccttccgggttcaagcaattctcatgcctcaccctcccaagtagctgggactacaggctcatgtcaccatgcccgactcatgttttgtattttagtagagacgggttcaccatgttgcccaagctggtctggaactcctgagctcaggcagtctgcccacatcggcctcccaaagtgttaggattacaggcgtgagccaccgcgcccggtccgagacagagaatcttgtccttgacggtgagacatttcaaaatgcccatcacagtaagccagcccctccccccaacaaactcgttcccttataaaaggaacacaggaaataacagtcattcctttctaaaaggaataataaatatgtacagctaaaattgcattcttcaggggccatggcgattagatgagattgtatagaaggaaagtatgacttgagtctggaaaggtcaggactgtcaccactcttcactgaccttgagaacaattcccagcccagcccttcctagcttataaaaacatttgtgaccttccatatgtcagtagtgtttctgctatctagttgttcatctcactggcgaacaagcgcgcagcctgtgggaagctcccaagttcctcgggccctttttggaagagcttctaagatatatgttgtatggctgcctacagcccagggggagtgcatttttacaatcattagcagtgaccttgtgaggtgtaggtgctattattcctggtccggggaggaaatcatgtggtcggtccagccctggctgttaggcctgagcccacactctgagggaccttttttggagcaatttgtttacatttgcttctcaccagataattaactagttaagtgctttaggatgcttagttactagctcctttgaagcatttcatttgttttcacctgggattgacctcctgcctctgtagcctgcatgagctcataaactgcatctgagaaatttgaactcagtgctgaagagccaagcgataatcctgctctcagttataatgctaagaacagtgactacaagtgagatgctggtcgaaatcttgatcataaatgagaaataactttttaacatttggccaagtggaaaaagataacataaataattattgggcagggcgcattgggtcacgcctgtaatcccagcactttggggggccgaggcaggcggatcacttgaggtcaggagttccagatcagcctggccaacatggtgaaaccttgtctctactgaaaatacaaaaattagccaggtgtggtggcaggtgcctgtaacccaagctacctgggaggctgaggcaggagaatcgcttgaacttgggaggcagaggttgcaatgagctgagattgtgtcactgcactccagcctgggcgacacagcgagactctgtctcaaaaaaaaaaaaaaaaaaacgttgctcaggatttttaaatggagggggcggtggtcttgccttgttacccagactgatctgaactcagatcgcttcaagtgatactcccacctcagcctcctcctgagtagctcagagtacaggtgcgtgagccactgcacctagccggcaggatttttaaatattgaacttgaatgcctttaccggctgttggctgctctctgctgtcctctcctctgctctcccctgcaatcctcctttacctgttgttacctcttgtgttccattctgcctgctttagccatttgggcttggaggcattgtgtttgccacccctgctgagtgctggcgattctaactgggatttgatgagggcacccttgggtgttaaagtgaaatctggtggatgagggttaatagtgtctttgtttcatcctccaaagtcagtaatgcctggtatttcctttgggagaggagccttgcagtcattataaaaggtagcaagagtggcttacacctgtaatcccagcactttgggaagtcaaggcgggtggattgcctgaggtcaagagttcaagaccagtctggccaacatggtgaaaccctgtcactactaaaaatacaaaaaaatgagcgggacgtggtcgtgtgcacctgtaatcccagctactcaggaggctgaggcaggggaattgcttgaactagggaggtggaggttgcagttagccaagatcatgacagagacagactctgtctcaaaaaaaaaaaaaaaaaaagcaagaaaggataggttctctctgccagttaacggcctacttttctccattaatggcaataggtcagaagactgggatttaaatgcctggtctgatttttggacaaatcactacctacccttctgtccacatcaatctcttaatttgtaaaactgaattaatagaatttgccttgcctggtagtgagagttaaaacacttagtaaagcgtcattcacaggtggatgtgggagccgagagtgccattgctctgagtgtgaaggcattgttcccggctctccagccactcacagtgtagcctctatctggtttgggttcaggattcctaagactggctgaagggtcactttcttgctgcccctgaggactaatatactctcctccgagaattgtattgcttagtgttgtacgaaaatcaacagggagaagcagttacagaaacacagagaaagcaggagccccattagattcgaccccattttatttccagggcaagactcttcaccattacatctgcctatcccgttactttcaggtatagggctgagtgtatccctccggcatggagaccctttgaggaggcactcaaaacaatacattgtctcaagatggcatctacaaagtttttgaggctttctagcctgggatacatctaaactgctaggcctggttgctgctgaagaattatttctgtttggcaacttcttttttttttttttttttgagatggagtcttgctctgtcgcccaggctggagtgcagtggtgtgatcagctcactgcaacctccgcctcccaggtttgagcaaattctcctgcctcagcctcccgagtagctggaattacaggcacctgccaccgtgacacctggctaatttttgtatttttattagagacagggtttcaccatgttggccggtctggtcttgaactcttgacctcaggtgatccacccacatcggcctcgcaaagtgttgggattacaggtttgagccaccgtgcttttggcaacttatttatagctttaagatcggggccttgggagtcagctgtttttgtctgttactgctataggccttaggaaacctgggcttgcactgacctggcctgaggtgtagcagcaggctgggatgttgttatctgtcagcccttatcctactttatttatttattttgagacggagtcttgcaggctggagtgcagtggtgcagtctcggctcattacaacctccaccctctgggttcaagtgattctcctgcctgagcctcccgagtagctgggattacaggcacgtgccaccacgcccggctaatttttgtatttttggtggagaggaggttttgccattttgaccaggctggtctcgagctcctgacctcaggggatccacccgcctcggcctcccaaagtgctggggttacaggtgtgagccactgtgcccgacctccttatatcctactttattagctcctgatgccacctgcctgccagtgtcctgaacatttttgcttccccttcttgagatttagggttcagttgtgttttgttttgtttttgagatggagtctcgctctgtcgcccaggctggagtgcagtggcacgatcttggctcactgcaagctccgcctctgggattcacgccattctcctgcctcagcctcccaagtagctgggactacatgtgcctgccaccacgcccggctaattttttgtttttagtagagacggggttttaccatgttagccagaatggcctcgtgatccgcccgcctcgtcctcccaaagtgctgggattacaggcgtgagccactacgccctgccttagggttcagttctgtcacttactagttgtgcatagttgtgcagtcagaggcaaatcacttaacttccgggtatgcagcaaggctgctggacgctccacaggttgtagc

SEQ ID NO: 565 - DNA, 59230 bp, Homo sapiens
aatttcaccaagagaacaccattctggttaagaaggattctcttttaaaccaaatggaacttctgggaggctccaggctgtcagccagtcacacctccaggaggattagcaaggctgattctccttctccttcccacctgctcgaggtgagctgcatgggccactagaagtgttcatggaggccggggaaagcgagtctttggggctgggaattgcccaccacaccacaccccacttctcactacatgtgagctatgttggagcaggtcagagatggatgtcagctcctgggccctgggggaagaaaggagtaagggctgccctgtctgtgtgcttcccagaggccactgcacactgggctgggagctggatctccattgtctcattcagtcccctcagcaggctgctgggaggattgtggtgtgagcctgttctacggtgagacatactccttcccttctcccctttctccacttcactggctgctccaggtaccccaccccaatagagcctgtacccattagtaacctgggtaaggcaggtgtctgaagggcaacctgaaagactgacccacggcttgcaggggtctctgagcccactctagccagcccttccccctcccatgactcaggtattgcagggagtgagcactggcctcagagtcagcctctgagatgtgggacaatgtcttgatctgtttcctccattgtgaaatggggggtggagaggcagcatccccctcacaggctggcctgagggcagtgaaggagaggtggaactttcctgactagctagaggggccacccatgcaggacccagggcaggctccaactcgctcctagagactggctaggtgcagtggcctgggaaagaggtgggggggctgctctccaggcccagaaggacccaactcatttgacagaggactccaaagagaaaacataatcctggagctgcctgcggggccccagaagagctctgccttgcaggaatgagttccctgtcctgccctgaccagctgaccgtcactgaaaatacagtcccaaaccacagcttcccaggatgtcctcgcctgacccctggctgctctgacctgtgtcctgggacatctgtcaccagcctctcctctgctaatagagggaggagcaccagggccctcccatgacccccccagcccaccctctgccacttagaaactgccaggcaagtctcatactcctgcttcaagtccctcctgacagcccactgtgcccagacgtaacttggtcttgagccacattcttcactgtccccgggaatcttaagaggagaggtaggaatctaggtgagaatcttaggaccctctgggagggtccacagagacctcagactcaacatgcccaaggaaaacatctccacctcctctctcccgattccatctcttcagctaggctggaaacctaggagtccctgtgtctgtctctccagcctccactcatctagctggccatgaagtcaggttaacactctctctaaaacaacccacagctctcatgttccccaccacagctggccccacctctgaattctgcctctgttctctgccttcctaatccttcttctgtgtggctgctagggtggtctttctgtctaaaacagactcagcctcctaccaagcacagagacgatgttaacccttcagcctggcaccagaggtggatgagtctgtccttccttccagcttcgggccctttccagctcctccagtcacatcagcccattctctctgaggctgttcctgtctccctctttggtgccccgaagcatgttccaggcacttctgcccttccactccaatgcccaatttagaggtgacatcacttgttaactgggttcccattccctccgctgctcagccagcccctgtctgtgagccctggtacaagtggctctctagccctttctgcagctctctctctaccctgacctgctccttcccaaagtcccctccctcagaaaacattccctgacacacagtggtagaaagagcagggccactgggaacgaggatgacctggactttttaatgatagtcatgactttttgtcagcaattactttttaaaaagatgacttgctttttcattgaggaacagggatttgcagttgactctgcgctttgccctgtctgaagtcagttcccctccctgaggctctgtttctagcacacaacgcagcctcacacctgtgcactcagtgatgggcactgcggggagggcgcaggtgctcagtggaggccgccatggactgtcctctgtccacttggggtggccctgtgatctggggctggtgaggtccttccagtgcctgtctcctcttgggtctgcatctggggctcctctttgcctgggacttggccctgcatgggcgagagatggaggatgaggccagagctcttcaccactttcagccttaggcccctttcgcagtctggaaaacctatgacctgttctcaaaaatacttcctcaatgcataaaagaaaaatacatggggctacaaagggaattaataacattggccaggcacggtggttcacgcctgtaatcccaacactttgggaggctgaggcaggctgatcacctgaggtcgggagttcaagaccaccctgaccaacatggcgaaaccctgtctctactaaaaatacaaaattagctgggtgtggtggcacatgcctgtaatcccagctacttgggaggctgaggcaagagaattgcttgaacccaggaggcagaggttgtggtgagccgagatcacaccattgtactccagcctgggcaacagagcaaaactccatctcaaacaaaaacaaaaacattggaatacagttatctgcaggaactcctcagggtcatggaccacaaggctcagcccaagagcctagagtctcttggagggccccacacttcccctccccgtagccagttttaggatccaaggttgacttgagtctgtttgggtggcatgtggcctccaaaaggcttaagctttaaagtctgggtgatcctgtgtgccctagccccaaatatggccccttcccgtgcatgggggtgggagagagacatgcccccacagggccaggccttaccaaaggcgaggaaacaggcccaggcagcccacccaggagtccccagcagctgcctcagcccctcctgccctcttcccagccctgggggggctgagccgagtaactccagctatgcagcccggccggtccacctgggtgtgagtgggcagggctgtcctcaagggggtggccccctacacctgcagggccacaggaacacagagggaaaaagatactggggggagggtgctaggaaaagactgagcaaccacagcagctcctgtctgcctgctcccatatgggattctcaacacaagccaagtccggccctgagtgcttcacacacatcagttcatttaatctgagtgaggacgttattcccatgttgcaggtgaggaaactgaggctcgattaacttgtctaagtcaccaagctgggacagatgccacccccagcagtcttgctccagatacttctctgcctgccacagcaggtggtggtgttcccatcgaacagctgagaaaactgagggagcagttcattcccaccctcttcctcaacctcccctgctcccccagccctcctttcttgaaccccctcccacacttagccaccaaccccggagcttagcatatctcaaacttgttctcatgggaccagataaatccctgcccaggtctgagaggcgctggcctcaaggctaggacacaggactctggttagggtctcagccagactctgcagagagtgatcagaaaggactgcaaggctgagactgtgccagaggagtggggaggagaaaggctcctgaagaccagatctctgcacgaccgtggcggcccctgcagctctgcacagcccctcctccccttttcctcaaaagaagcaaatcctccatgaaagatttttggcttcacagaaggacttggccccatctgagaacacgtgagccatctctagaagtgctgagtccccatcagtggaggcactcggcaccagagaatgcctttcccgggaggggcactgctgggcaggtggaagggctctcccctcctctcccctcctctcttcttctctgatatctaatgatcactacaaactcaacaagtcccagaatggactcctgacctcctcctacctcagcctcccagctgccttcctcattttacgcagctccttttttctcaacaaggggctcagtccccaaaactcaggcctgaggagggccacagtgtggaagacgatggtaaaagaatggccagcccatgccggacacagtgtgcctggaaaggaagccccttcctagaggagtgaggacccagccactgatgaaatgctgtccctccagagagcaaggaggaaggtgcagtttctcctggtgtccagagagttcccagggagcccctttgctccagcagaaggcaacagacaggctgggtggggagggagccgcatgatatgagggctggggaagagggatcctttttcaggtataacctaaatcctaccagttttctttccccactggcctggaaagaacaaacacctccagattcttaagcatccaagggtcaaatagggcactcggctgcaggtggaccctccccaagcagtggcccttgtctcactttgcttctaatgcccaccgacacagcctcccccaggaaaaggcaatctgctcaggactcctctgaggcaagcccctgctgtcagatgctgatcctcccccttacagcctctgaaacctgtcctgtaccctcgccatagcccagaggctgccattccccagctcacatgccctatgtggcttccttctgcttagagaatgcagggacagtggtcctaaaagcatagcctgtccttttgcctcttcgctggtccccaacatcttgtgagctccttgaaggtggcaccacatcagaaaataatggttgctggatgaatagctacctggataaaatattcaaggcctcacagccatgatacatgctaggcacttgtggcaaagcaacaccaaagctggggccacccttgggctctccctggccatgtgggaggctgcaggtggctaaggaagccaaagcataaaagccccagctcagagcctggtccataggtgtccactgcatgtgtggggaggctcaggaaggccaatcctggctggacacccgcgggagcagctgaggttcacccagagccttgcacagtactggacacagtgcgtaggtgctcaacacaggtttgttaatagtaaatgaagtctcacggctcacgtctgtaatcccaacactttgggaggctgagatgggcagatcacttgaggttaggagtttgagaccagcttggccaacatggcaaaaccccgtctctactaaaaatacaaaaaaaaaaaaaaaattagctgggcgtggtggcatgcacctgtagtcccagctactcaggaggctgaggcatgagaattgcttgaacccaggaggtggtggttgcagtgagcaaagatcatgccactgcactgcagcctgggtgacagaagagacaatctcaaaaaaaaaaaaaaagagtcaatgcagcttgtttgtcacatcttcacatccatccctgattaatcacaacactgggctggggaccatgtggcctgagtctgccctggcagtgagaggggacagagggaggtatgctgctaccttccagattcctgcaggcatccatgctgcctctcctcccatctacctgcccaccccctgtctgccctgactccatgtcggagggggcttcaaatatggcctggcaggctggttgcaatggctcacacctgtaatctcagtactttgggagggcaagatgggaggatcacttgaagccaggagttcaagatcagcctgggcaacatagtgagaccaccgcctctacaattttttttttttaagatgacttgggcaagcactgctgtgggccagaactttcacacacacatgccctttccccatcctcactcctatgctagaaggtcgttctctggagtccctgggccccgagtcactaagcgggtccccaaggtaggcttcagaatcaaaggggcagactatttgaaaccagggccacatcaccatcatatgaggttcttatccccattttagaaatgatgaaattgaaacccaaacagatgaagtcacttgtccggagttacatctgattagcagcaaggggttgctgaagcacaaagcttggtctctagggtaggggtcataactggtcatcaaaaatggggttggggctacagaggcaggccatggccactgcccagctctcccactcactaagaacccccactctgcctccaaccctgaagatgaatattccaaaggctgacactgtccatacctcggtactaaaggaaaagacagaaggcactcagggggttcgcactgcagtcccctttccttggctaagcaaactggggaaatgctggcctcaacagtaaccacagccctgagcacctgcacctagagtcattcaagactaggactcaggtctcccagctctgactcctttcatcctcacaatatcctgcttaggaggtggacaccattcttcactctattttctcacctcacagatgagatacagagtgtttaacaagtgtgtggaagcgttaactatgattcatcaagatgcttatgaaactgctcggagaagagcaattgccacttgttcctggagacaagtggaccctaaaaaaaaagctggacagcctctctccaagccacatagtcagagatgagatgaccagcccagaccctgacccagccagtgtgaactcttcccacttaaaggctggcctagtgcctcaatctcatacccctggtcgcttggttctggcggtcctactgcaagtaatatggccatggagtgagcactgagtggggaggtcaggaaacccaggctgcaggcatgactctgtcctcagcacatcagagagggatggactggggtgagggtttcttgacataaggtccccatgggcttcaggggatccaagaatcctctaaagcagaatgcaaagtctggtgtcaattaacggaagtgcatttttctggggatggctttcatcagtgtctccaagggctctgtaaatcaaaaaaagttatggatacccagaatgggtaatcttggaggctccttccatgccctagtattcctgggttatatatgggtttaaacgtgaagtacactccccatccttcaaggccaattcagtggctgctctgggaagctctaacagatttcttgcttctttgactgcagggaaaggctgggagcccaacaccacagagcctggcagggtccctctgccctgatctccctcaccagacagccagctcccaaaagggggcaggaccagcccaaggctaaggtagcagatgccagcaccccatacttgacctcttgtggctcaccgccccccccccacagtctctgtcccctgaagggggtctcagggctgcagagcacaggggcactggggcctggagtccacatctccctgctgcagccctggagctttgcagagccatgctccttccaggaacctggttttcattaaatcgggtaaaggagtcgataaccgccaagtccaggagaggcaaagttctgctagaaggcacagggaaggtgagggagaccagcctgtctcttgccctccctggctgaccgacggcagggggaggggaaggcagggctcctaagggtccagcaatggcagcagtcggagcttggggggagagtcgggggagtcctggcccagataataagcaattgttaatgtgatccatatggatcctgactggcctctctgtttaacagaatgataatggcagggaaagaatgctggtctgtggggaagggaaggggcaaagtcctccccggacttgggggggtggggtagggtcatggggaggagaaggaggcaaataagggaaagggagaggaggagccccacccaggggtctccaccacccaagagcacagagctgtttacctgaaggtggccagattccatgctatgcagactgcctggctaaaggcccttacaaaaccccttttattcagccaaccaatatttatggagcacccacaaggtgtcaagccctgtggcaagcccactgggggcagggccagggagtacatgctccatttcagtcaaagccctgagtggaccccgccacaaaggcggaagggagcacaggtgcaggccacggagggaggagcaagtgacagaagctcggggctggggaggtgatgcggaggaggtgcgcatccgagttgggccctgaagaataaggaggttgtggaaagacagggacaatgaggaaggcatttggctggaggaacagcgggagcaaaggcagagaggcgtgaaattgcgtggagagagccctagatctcagcaataaagctgcggcccaggcagggcagggaggggagtcctgatccataaaaagctgtggccatgggtgagcagaagaaaggcaggaaagggctctgcgacgccacactcagtctgggtggctctccccagccttcgcccaggctggtactggaattgacagttacgggatcctcagcccagccctcagccataccacggccagagaatcgggcagggcctccgaagccaaactcatttctgtgtctctcagccccttctgtttcttcttctggggcgggggtgggggcaacaggaatccccccgaggaatgcgggtcctctaggcctccccaggagcaactcctctgccccacacagcctaattccctttggcccaaaagggcttcgcccagaagatattacagcgaggacacgagggtcgctcccgtctgccttggatgccaatggaatcaagtggaaagaaatgaaatggtgttaaacatgggaaaggggatttacgaggcctgtcacccgtccagcccagccaccccagcaagccccgcccctttcctcgcccaccccaggaagtcccgccccgccccctgcccgcagctcgcgcggccgcccggtacccgcgtcccacagctgggtggcggcggcaccacagcaccgggcagcccggcgcgcccgtccttgggggctcaggcacagcggggaatggcgtcggttccggactgagaggctcggggaggctttaggaggatgctatgggatttcggggtaggctccgggagggtctgggactccctctgcagggtcagagggtttcgcaccgtggcatctgcgggcccagcccactccagagactgggcggctccacaggggaggccccacggcccaggaaccgggaagcccacctgcgccgtaagcccagagttgggctggaaccgggtccccactcctcgctgccgggcggaaagcaggagaccgctccgccgccacagcccgtgcggacaacacaaacattcttcagtcctctattctcctccaaattaggtatccatggagacagggccggcagcctgacagccctacggcctaatcctgatttagtgaccgtccctttaacagcccacccacccgtccacccacccctgcgctccgggccgccgctgggcgcagggtccaggccgcgcgctctctgccccgcgcagaccccttcccaggcctcctcctctggcgggggcagggggaccagcggggctggggaagggcaccagcatttgctgatcacctacagggtgctcagcaatctgcgaaggaccctctgcagcggcgggggggttgctagcatgcgaatctctgtgtagaacaggagagggctcttgcggtggggaagtttgaggggccctctctggagagctgggcgctccgggggtcccccttgttgcctgtagccccagggtgaaggtgagtacagcctcctacaaccccctgactctgagacgcgggctctgttctcccgggccagaggagaagacatgaagagggtgggtgttaggggcgcggggaccctaagtagcctcggcctcctgtcactgccccgtcaccatgctggggaatctccgggccagtaacccagcccccacccctcccacacacacacacaggggccgctggacaaagacctgacggagtgggaggggcctgcgggccggccctcgggctccggacgctggatccttctgggacccgaacccgcaaaccttggctccccacccccaggccagcagacgcccccgagccggctgctcgctttcgctgcagcccccgcaccagagggggctgcgagacgggtgcccgtcggcggccgggcggctatcccctgctctgcccgccccctccccccgagaagtgaccctcggctcccacgtacccgctagggtctctcgccggccctgccctccgacccccgccgagctgaaccccgcgactagcagcccccgccctctcggccctctccggccccgggccggcggacaaagctccggacaccctgaccgaacggtcacctccccccgccccatcccggcccgcccgcggccccgtacctcggcatcacggccgggtcctaggtgagtgtgcgcggcctgggggcgcgtccggcccggggaccggggcggcggcgcgggccgggggcgacaggcctgggctggggggcagtggcgctcaccatcctggagccgctgctgctgcggctgctgcggccgccgcgggcgggagcgggactgggcagtgggggtggccggacaaggggcggccccggctccccccgcaggaaagacccccacccccacccccgcctcccctcgcccgcccccagggccctccctcgcaggccctccctcccctcccctttccctgctcctccctctcctagtgcccctctcttcccccagctcccgccccttctctggcccctccacccccggcttcttccccgccctcccccacctcgcccccgccccgcccccacctcccctgggctcgcccagcccctccttgccaccctcccggctggccccgccccctcccgcccctggctctaaaataaattagccacagaggggaaaaaagagcaagtgaccctcggtgtggagagtgtccttcgccactctcagacccgtccgccccgcctctcccggccgtcggagcgggaagctggggttggggtgggggtcgggccggcgggtaggggtgggggacggcatggggacggggccgaggccgggactgagcagcccagcccgtcgagcgtgtccgctggatgtgggcggcttcctgggtcgaagggcaaaggggaaggcagccggcctgggcccgccccgtccgcgggccgccccagaccccctttcccaggactgccttggccccctggccccagtctggaggactcttgctcacttcctccgcccccaggtgagctgagaacccactgcgcgcgggactctgctgcgcctgccctcccgggctgcagagggcaggacgcaccgccaggcaaggccgcggctctgcgctgatgccactccgggagcgggtggctgcgggggaggagggcgagcactggacgggggcagcggagtgtagggtgtgagatctaaacagagggctccactggagggcttgcccagaaggcggcagtcacactgggccaagcaggatgactggcaggaagaaaagatgagggatgaatcccagacctctagtccactgagagtgtccaaagacatccgttcaatagatacatactgagtgttaactttgtgccaaacattggactgtgcaccagggatacccaagagagtccaagaggcacagccctgtcttcctggagctcccagtcgaagggtagacagaattctgcccgacacacacacactcaaggcttcatcagggataaaggccaggaaccggctttgccccaggagaaggtaggaggagggctgtgctgatgatggagggtccagagaaccttcctgctgttgagcctccagatgtcccaaggcaatcctgtttccacccaagggcagtgcttaagggtcctctctcctgagagcttgtttcccttttgagtggctgcctagcctgagtgtcagtagggcaagattggccctcacccactagcctgtagaactccaaacactaccccctcccttcttctaatgcagattcccctgcaggctctggggtctgacaggtctggggcactcctttaggtgccactcagggaaacagaaggggagggcctcagtagctcccacttcttttccagcccacatttggaagcaaccggcacccacgcaggttctggaacttgccaaggtcagtgtcttttccacctccagaattatctcttccttgccactccccacccccagggctctgccctggcacaggaggagggacgtgtcaaggctcagagtgctagagtagcccctggcttcagaatcaggcaggatgaagggagccacaaccaccatgctaggagactggaacccttgctggaggaacaatcccaggataccagctggaaggaactccttggctatttccttattgttggagcactggaggcccagagaggagaagtgacacacttggggtcacacagcaaagctggatctagaatccactgcactttttccacccctacctgtcaggttccctgacagccagagacaggaactaagggaaagactaatatccttatgagctgggtgcctcagccagcaggattagtgccaggaagccaagtctggcattgccaatggggatcctgctccaccatgctccagggaaggggggatgacaggagtggggttggactgaggcgctcagtgtgaaggaaggaattgatcatgcgctcccctggagcggggatccggttctccttcatcctctaggagtccgggagtaaaggaaggacaagcttaaagctaaggaaggccttgctagtgagatagtggaagacaccagcctgctggataaggccttcgctggactccaggggcaagaccagcagcttggcagtactgagttgtttccaatgggcggactgctgtgggtgatattaagaggtttagttagcaggtgggggtgaggttgatcatttcacccctccacctcccaccctgcaccagtgctcagggcgatgaagtgtggctccccctcccagagctcattaaagtcctgttaatacatcatccagcctcctgggctgacaaatactctgttcatcacatctctacctcctgccctcttgggcagggcccgagagactgatctctgaggactctggggtgacctcactcctggctgtccccagtcaagggatctgtgccctgagagcccctgctgaggtggctgtgatcatccccaggcaggtcaagtgcctggcaatggattggataataatagtggtaatgatggtggtaatgtgtggcttctgcagagggccctccattctttcccagatcttttgctagtatcacacccaaggtggagaatcccacccccatcctgcccccaggggagacaggtgctatgcttggttgtgtggctgagtgcaggcacctgctgcgggcgcatgcatgtgggtgtgcagcagaagtgtgggagtgtgtgaccttcctggtccagagacctgcaacaagggctttctaaaaacattaagaagaaaaataactccgtgggtctagggagaatcagctcaaaggattttggagggaggggggagagttagagggaggaagtaaaagctagagagagagggcgggaggagcaagtagggtgaggaggaaggaaagaaaagggccccgggttgggggaaggatggggtggggggaggaagggagaaagaaatggaagagaggaagaggaaagggcggggaggcctctttgtggtcctctggactggccactcaggagtcattatgagcaggaaaggaaggaaatgtgtcctggcttggggattggggtgcgtgcccagagggcaccacacccagctgggcttccccccaaccacacttgcccgggactcaggctgctgtccccacaaatggaaactctagcccttctcattcttgctctttgcccatcaaggcccagttcccagtgcctccccaaccctgatcaaaccaccccaaaaactcttactcttcatgaacgtataccagctttgccttcccactgtgctacaagctgtgtctagtctggatcctatccccaccccacatccagcctaggagccctcgaaagcctgtaggcaaactagaaaacatgttcctccctctatgcagctcagacttgggaggaggagctgggtggctatcagtctccgctaactccttggggcccaacacttggggacgctgatacctcgcttccaaaatcgttaccccacacatggccctgctgtttgttctttgagcagaagcacatcctgcaccatcctgcagcatagctcttcagccagcaccccaaattgatcccaccatgtaccttacagtcacacagaaactcccactaaacatgcatacctttttaatacctcagaatctttctgcctggaatctcatttccctactctgcctgatgagctcctattcatccttcagaacccaactcaggtatgcccttctctgtaaagtcttccctatctgtcccgcatcctagcagagcacttccaatcttttttttcccctaggttccaggggttgagcccactccatcctgtccaaaggcagaagcctcctccaagtcctgcacgatccgccctctaacatgcaagcccatctggaacctctggaatcctactgggcttcttcgctccctaaagtttacagacccagggcaaaatagggaactgcaaatccaagtggcccagaggtctctccacccccactctgccctctctgggcctgagcctgacaggagattcccagcacatctggttgtacttaaatcatccagcactactggagtaggttccctgcttctctcccttcagccccagcctcctccccttcctacaccagccttccaggtctctcctccaggatgccttccctaactcatccagcctcggtatctgcaccccacccttgaacctccacctctttgggtctggagtctgccagggtgtggaagggagggtgtgtgctccgcaagactcagtgtgtagaatctcatccttcccgagcattggtcctagatagaaaccttcccttcaggtaaggaagggagccagccaagagcctcccctctgctcccttggcctcaggggtggctgtctccagttatgggtgtgtacagtggggaggaacaagttcagatccaggcagagccattcctttggcaactcttgctgtcagccatcttccaaagagctttgcaaaatgttaaagaacaaaagagaaataaatacagagaatatagcaagtataaaaatgcacagtctaggccaggcacggtggctcacacctgtaatcctagcactttgggaggctgaggcagatggatcacttgaggtcaggaatttgaaaccagcctggccaagatggtgaaaccccatctctactaaaaatacaaaaattagccaggtgtggtggcgggcacctgtagtcccagctatttgggaggctgaggcagaagaattacttgaaccccggaagtggaggttgtagtgagccaagatcacaccactgcaccccagcctggctgacaaagcaagattctgtctcaaaaaaaaaaaaaaaaaaaaaaaagaatgcacggactctaaagaacaagtttgtaacctaccatgacctgctccaccagggctccaggtttgaatgttcattcattcttttattcaatagcatgtactgatgcctgagtctactaagttctaggaacagtgactcaagtaagatcccagggtcagtgggggacaggaacaggtggatgaacaaatgctgcatgctgtaatggacatgagtcagggagacagaggggtgccaaggttgaaggtcagagaccctggactgaatcccacctctgtcactttctgcactgtctctggggagccacttaatcttggggagcctgtctccccacctggaaaaggacgatgatgtgacctcacagggtcgtagtgggactcaaataagataatgtgtgtgaaaacgccttgcaaagtgctaagtgagttgttgctattatgattaggctcaggggctgcctatctgacactcatttttctaatgcctcaacagctgtctctcttaccctcccagggcaggtaccacgttggagaaacttctgagggtgaaggacacccaccctagagtagtgggcagttaagctgcccgcatagacacacacacacacactttagttacacaagcagaacacctttttataaaaattcgaaaggcatcatgtgcctacagcctcagttactcaggaggccgaggcaagaggattgcatgagtcctgggcaacagagtgaaacccatttctactatttaaaaaacactaataagaaaaaatagataagcagaaaacaaaaaaattaaaaatccaacgcctttaatcccaccacccagagataaccaccagtaatatgttggagtcagttagccggtcacagtggtggggggcctgtggtcccagctactcgggagactaaggtgggaggattgcttgagccagggagattgaggctgcagtgagccgtgattgcgccaatgcactccaccctgggcaacaaagcaagaccccatttcaaaacaaaacaaacaaaaaaccattttggagtcagctagatattattctatttatctctctctacacacacacacacacacacacacacacacacacacacacacacacacatatgtatatatagagagatctccacagtgttttataatatacttttcttaatagacaatttttttttttgagagggagtcttgctctgttgcccaggctggagtgcagtggtgtgatcgcggctcactgcaacctccacctcccaggttcaagcaattctcctgcctcagcctcctaagtagctgggattacaggcatgtgccaccacagctggctgattttggcatttttagtagagacgggtttcaccatgttgaccagtctggtctcaaactcctgacctcaagtgatccacctgccttggcctcccaaagtgctgggattacaggcgtgagccaccgcacccagacaatggacaaatattttgaacatcttttgctgtctataatacgtttataccacacaattgttaatgacagcttaatattccatcaagtggacatgtctaaattaatttaaaaagtttcctggccaggtgcggtggctcttgcctgtaatcccagcactttgggaggccaaggcgggcggatcatgaggtcaggagtttgagaccagcctggccaacatgatgaaaccccatctctactcaaaatacaaaagttaggtgggcatggtggcgcactcctgtagtcccagctactaggcaggctgaggcaggagaatagcttgaacctgggaggcagaggtagcagtgagccaagatctcacctctgcattcaagcctgggcaacagagtaagactcttctggaaaaaaaaaaaaaagtttcctttgttgttgatttttttccagaaataaaagcttcatgaacaaacctgtaacttccacctttgtgcacgcgtctaattattgccttaggataaagttctggtaaccagaggctaggaatgcatatttttatctctgaggagccaggagcccaggcctctgggcagtgctctcacctctcctccaggcagccctcccagacctccagggttgagtacatctcccatggtcctttcctctccaagtaacttcatctcttagagacctgccctgagacccctgaaaaatgctgggaaagtctggctggtgacggccaggaggggccggggtggagagcacaaagcaggcttgtctggggcacgggaagaggccccgccctccgtgctgctggtccaacattcctcctggacaatggctgccttgggaatcccgggaatgaaggaggcgggcggcttcccgaacctgcgccctccacccccatcaagttgcgccctttccccagatggaaagcaggggcactttgcattgcggcagggtggggaggccagctagcctccatgcctacagcccccgcccctccttttaccaacactaatccacaacgccccgcagccgagtcctgctcagccaccccatccccatggaccttgggcgagtcctgctccttcaactgtaaaatcaggagcttggattcagtggttgcaaaactccccacagatctcaaaggccgaaatgtagtgactaaggcatgcacaggctttggagccaggttgcccgagttcaaatcctgggctgccctttaccctgggaacttaagcccctgggttgccggcttccctctcgcaaagtgtgtttgttgatacagctccactccctcccgatgggaaggcaaactcctcaaagtctataaatcccgatccatgtgtaactctgctcaaaacactaaccagatctccaaccccaggccccctcataccctgtgcggattttggcccctggacatttgcccaacaactggccacacttctgggagctgcgacgggcacctgatatccctgacgaagcatccttccccagcatgtttccatcttcccttgcatcagtcataaggccgtaaagctgtaaatggtaaaggcttactggggcacacaaaaattttaaatataggaaaactcttatttatttatttatttagagacagagtctcaccctgtcgcccaggctggagtgcagtggtgtgatcttggctctctacaacctccacctcccgggttcaagtgattctcctgcctcagcctcctgagtagctgggattacaggcatgcgccaccacgctcaactaatttttgtaggttttgtttgtttgttcgtttgagtagagatgaattttcgccacattggccaggctgctctcgaactgctgacctcaagtgatctgcccgccttggcctcccaaagtgctgggatgatgggcatgaaccactgcaccagccagaaaactcttatgttaggtcatatgtccttatttttgtttgggaaatgcaggcatttccaatgccaccagcaattgctaggcatcatgggtggtatacaccccaggctcttattaacctattggagggttagaacaaacacacttcaacagggacccattcacaaagttacctctggaaatattcctgagctttttgccacaaatccctgcccactctccctcatagacttgttccctgcttccccttactcacctcctcctcagccctattcctatgctcccctgaattcagatcctctgctgcaagtgccagaaaactcccctcataatggcttctactataaggaaaatacatgatcgtatttcatccaatttagacaccaatgatgttaagaagcactgctgcttcatgtacttgattgattgattgattgattgattgattgattgatttttcagagacagggtcttgctgtgttgctcaggctggtcttgaactcctgggctgaagccatccttccacctcggcctcccaaagtgctgggattacaggcatgaaccaccatacttcatgtactttagaaagaaaaaacactggccgggcgcggtggctcacgcctgtaatcccagcactttgggaggctgaggcgggtggatcacaagatcaggagttcaagaccagactggccaacatggtgaaaccctgtgtctactaaaaatacaacaattagctgggcgtggtggcaggtgcctgtaatcccagctattcaggaggctgaggcaggagaattgcttgaagccgggaggcagaggttgcagtgagccgagatcctgccactgcactccagcctgggtaacagagcaagactccatctgaaaaaaaaaaaaaaaaaaaaaaagaaagaaagaaaaaacactaaaactgcggattaaagtgatgatgacttcttatcacttagaatttttattttacacttactgaaaaggttctcttagacttactacctttgtacttacgtaacaaggaaaacatgggtgaaataaactggttaaggttttcctaaaacttcaccccattcagagtctgattcttggatcacttttcaattcccagctgtcaatatctgtttttccacacagaatcagcatctgggccatcttacaagtactggtgatacagaacatttcttaaaagtgctctaccaggctgggcgtggtggctcacacctgtaatcccagcactttgggaggccaaggtgggcagattacttgaggtcaggagttcaagaccaacctggccaacatggtgaaaccccgtctctattaaaaatacaaaaaaattagcctggcatggtggcacacacctgtaatcccagttacttgggaggctgaggcacaagagttgcttgaacccaggaagcggaggttgcagtgagctgagattgcaccactgcactccagcctgagtgacagagtgagaccccgtctcaaaaaaaaaaaaaaaaagtgggccgggcgcagtggctcaagcctataatcccagcactttgggatgccgaggtgggcagatcatctgaggtcaggagttcgagaccagcctggccaacatggtgaaaccccgtctctactaaaagtacaaaaattagccaggcgtggtggtgggcgcctgtagtcccagctactcaggaggctgaggcaggagaatccctggaacccaggaggtagagattctagcgagccgagatcgtgccgctgcactgtagcctgggcgacagagcgagactgtccccccccaccaaaaaaagtgctctaccaaattatctattgctgcataaaagattaccccaaatcggctgggcatggtggctcatgcctgtaatcccagcactttgggaggccaaggcgggcagatcacctgaggttgggagttcgagaccaccctgaccaacatggagaaaccccgtctctactaaaaatacaaaattagccgggtgtggtggcacatgcctgttatcccagctgctcaggaggctgaggcaggagaattgcttgaacccaggaggcggagtttgcggtgagccgagatcacgccatttcactccagattaccccaaatcttagcagctttaagcaatcaacattttatattatactttctgtgggtcaggactctgggtatggcttaactgggtggttctggctcctggtctcttatgaggctgcactcaagctgtcctctgggggctgcaggcatgtgggactggagagcccactttcaagttcactcacatggctgtgcacagaccttggttcctagctggctactggctagagaccacctcagggcctcaacacatgggcctccctataggcctcctaactgtctttatgacatggccctggcttcccacccccacagcaaatgatccaagagaaagcacaagtaagcattcaagacagaagagacagtttttttgtttttgtttttgtttttgagatggagtcttgctctgtcgcccaacctagagtacaatagctcaatctcagctcactgcaacctccgcctcccaggttcaagcgattctcccacctcagccaaccgagtagctgggattacaggcacccgccatcatgcccgtctaatccatctaaattttgtatttttggagagatggggtttcaccctgttggccaggctggtcttgaactcctgacctcaggtgatctgcctgcctcagcctcccaaagtgctgggattacaggcatgccccaccatgcctgactaattttgtatttttagtagagatggggtttcatcacgttggctgggctggtcttgaattcctgacctcaggtgatccactcgcctcagcctcccaaagtgctgagattacaggtgtgagccaccgtgcccggcagccatagtctttttataacctaatagcagaagcgacatcacagaatttatttaattatttttttcagacagggtcttactctgttgcccaggctgaagtgcagtggcacaatctcggcttactgcaggctcgacctcctgggctctgtgattctccttcctcagcttcctgagtagctgggactacaggtgtgtgccaccatgcctggctaatttttttagttttctgtagagacgaggtctccctatgttgcccaggctggtctcaaattccatttaagaatggacacatggcatgatttggcctatgagacataaggggatgttttgtgggaagcttctaaaaagatttcacagaggctgaaagagaaacagtttttcttggcctctgaatgtcattgtctgcctgtggtgtctgaaactgcagcatctaccttgtgactttgagggaagtcaggatacaaggacaaaaatccagaggataaggatggcagaaaaaagagaaagaaatgtggtggaatattttgagtggaaacctattcagcaataacaatgagccaggcatgagctcgtgcctgtaatctaatgctttgagaggctgaggcaggtggattgcttgagcctaagagtttgagactagcctgggcaacatagcgagaccctgtatctaaaaaaaaaaaaaaaaaaaaaaaaccagggccgggtgcggtggctcacgcctgtaatcccagcgctttgggaagccgaggcaggcagatcacaaggtcaggagatcgagaccatcctggctaacatggtgaaacaccatctctaccaaaaatacaaaaaaattagccgggcttggtggcaggcgcctgtagtcccagctactcgagaggctgaggcaggagaatggcgtgaacccaggaggcggagcttgcagtgagccgagatcgctccactgcactccagactgggtgacagagcgagactccatctcaaaaaaaaaaaacaaaaaactactgatacaataaaatgcgtgaatctcaataccattgtctgaagccaaagggccagacacagaagagtacatacaatataattccattcataggaagacctggaatatgcaaaactgatctagaggtaaacatcagattacctgtagcaggaggtggccggggatggggggactgactgcctatggacaggaggggacttgctgcatgatgtcaatattccacatcttgattggaatggtggtgaccaggtaaacacttgtcaaaattcatcaaactgtagttttaaaatctgtgcatcctggccaggtacagtggctcatgccccataatcccagcactttgggatgccgaggcaggcagatctcttgagtccaggagttcgagaccaacctggacaacatggtgacaccccatctctacaaaaaccacaaaaattagctagacatgatggtgcatgcctgtagtcccagctactcaggaggctgaggtggcaggatcacctcagcccgaggaggtcaattctgcagtaagctgtgattgtgctactgcactccagcctaggtgacagagggagacactgtcttaataaacaaataaacaataaaataaaatctgtgcatcctactgcatataaattgtatttcaataaagttgacgaaagaaggaaagaaaaagaaaaccaaacaaacaagaaacaaagaagtacagaagtaacctaggtccttgataacactgttgagccactgacttcaccaacagccttgggacttcttgttttgtgacattataaatgctgtataagccatttttaagttgggtctctcatagctggaagcccaaaacacctttatgtcaagggggaggagaggcatccagaaccagcctggggaagtgggttttgaagagcagctgagaaggcaagagactctgaagcgcgcttgatccggtggggtctgcttgctgctccaccatcaggcccagtatagctggggatttcttcccacagttccccaaccttccccagcccatctgtgaaatggagaccctggtaatcaaaggacctagtcttaggcttctggagagggctgatgcagagacaatgcctgaaagctcttagcacagagcctggcgcagacggaggttcaatgtggtgtacctcccctggccctggcaaggatgacctgagcctgaaccaagcaggggcaggcagagaggagggaacagaacttagaaacctttgggactgtaaatgatcgataacgccaagcactcgggcatgggtgacaatgtggatgggatcatttctcaggcttttggcaaagattacatgcaggatctgttttcatcaccaggtaggtgccggtaaaaggagagaagagatacagtaggagaaacaggtttggggggtgaaaaagtgtaagtttgaggtatctgtgagcagtacggcgtggtggacaagagcaagcgttctgccacccactagctatgtgatctgggtcaaactaccacctttctcggagcctcagtatcctcatctgtaaaatgggaattctaaaaatacttagctcattgggttgctataaagattacatgaggtcgggcacagtggctcatgcctaaaatcccagcactttgggaggctgaggctggtggatcacaagttcaggaatttgggagcagcctgacaaacatggtgaaaccctgtctctactaaaagtacaaaaattagctgggcgtggttgtgcacatttttaatcccagctactcaggaggctaaggaaggagaatcacttgaacccgggaggcagaggttgcagtgagctgagatcagccactgcactccagcctgggcgacagagcgagactccgtctcaaaacaaaacaaaacaaaacaaaacaaaactttagatgaaacataacaaaaagaaaaaaacaagattagatgaaacaatatattggcagtgcttagcatagtgcctggcacatagcaggtactccttaaacggtgataataaggtcatcatcccttcatcccttcacagcctgcgtcttcgggttaggcctaggagggcagcctcctgctgagcctctgcactagaataccaaactcagcgtgaggctctttgggctttcagcttactctctcttgcctcaaacaggatgatcccctgtggaagatttcttctcctttcctttttccttgaccccttccctccctcccttccagtctctactctgccctgcctctaacaggaagccttccttgactaatgtctctccattctctgccaacctccccactgcctccgtgtaggttctggccttccagcccagagctctatccaccctactccattgcccatgcccccagtacaaaccgtgggctttctccgtgccagctcaagggaggtctgaccccatggggacgcctgactgcaaagggaaggatgccgccttccaccgcagcaccaccacagctccgtggacccgctgggaaaggggtggggctggcgaggaggaggccacctgccagagtggcagcagacaggccagctaaatccttgacctatgatttaagaggtcgggcatagttcaatagagccctccaggctgagtcccagctcattcacacaggtcagagggatgaggggcaaggcggagaggagggccgtctcctccgagggcccttggcttcctccctagccttctggggcataatccagcctgaaaaccacaaaaaccctgaaaaccaccagctccattcccatcagcgtagatgccccctctgagaggccgggggaggagggcggggccgggagggggtgggcagcagggcaggaaagtggagatttaggcaggcacagcgcctggcacacagcaagggcgggaaaggctcctccctctgctaaccgcggcgccctttgttaggtcccgagacgcagcggagctgcctggcttccaggtcggccctggtctctgctcccctccgttgcctttggaatttgccctcagacctggaccctaccagggaacagcgggattgtctgatggaattccacgtgcaaaccgagagaggttttgccataaattctagtccggccccgggaggagggccacgcctgggccccactccccatcaccctcccgcctcccagacccccggcacagggcctccccaggccgtgccccgggctgcccctgggagcgctatgcaaatgagatgcaaagtaggccgaggcagccgcaaagattggctgccgcagaggctcagtccgcccaatccccggccgcccgccatcctgggcgcccccggcccggggcccggtcccgcccgtaaatcagctccgtcagcgttaatggctcctgactaattgcctggacttgggctccgggctcgggtcgccagcattaaaattcaatcaggcctagcgctatgctattaaatattcattgggagagcttcccgaaatcgggctgggggatggggacggactgggttggagggactacccgaatcctcagctccagaggaggtgccgctcctccccagcgtgctgtcagcttctgcagcggctgccgggcttccattcggctgggtctgatttctctctggaggtccctgcgccctctctagagacttttgggagactgagctgccctgcagaaggaatgttaagttatgccaagggggctgtgtctgctcaacgcctggtcacctcgccgcacgaccctttacccagtgcccaccatgagctcctattcatgctggaaccttaggtcccaccgggagtggaagagctccagggcacagaaggcttaatctttagaagagcccctacttccctggccctactgccgggtttttatggagctacactggccatcctcagcgtggctagagagagcatcagtctgggcagctccgggtgtgtgctggaagggagtagtgggctttgtacagtcctcccctcctcttccctgccctcaggaatgcagcctgtccgagctcctgggcccctggcctgatgctgagcaggctgcctggaagttctcaaagagggtaccaagggggagggggctgggcctgagggggcccttgggagtgtcagggacttaagcagaaactgcatcctccacccacacacacacacaatagtcagagggttatgaagagggcttagcagatgtgatgacagccatggctcaaggactgggtgagccactcaaataaagaccaagagtttttctaggccctctatgatgtattgacacatctcttcacgcggcagctctagtcctcagacaaggaggtatttgggtcgggaggaagagaaagtcttgggaagtgtgctaggagagactcatttccctcctctggattttcaaggactcctcaggagcaaaccacctgttcacagggcttgtcccctgccctttggactgctccttgctcctagtgcctgaggatggtgcaaggaattaaccctgtggggcatggggggaggctccgactgccagagccacagagcacccgcagacgctgcaggggaggggtggaggctgagggtaccggtctctgcaaggccagaagccatcaggactccaagagggttgtaaattcagggaatactgttttgatggacactggaaggaacttcttggtcggcaatctctgagagcatcaacccttggccgtgcaggaagcctggaattcctgcctgaggacccctactcccccagggtgtagatgatgatcttacagcaagtggggtccaaggagcaccctctctccagaaaccaggcaggccccagggcagaatgcgtctggcagcgattaggaggagagctggggctgggaggcctcagacttcagcaggtcaggagcgaccccagccaagtgtccgattccaaagccaaacgtcacaggcaatccgggattccaaactcaccccacgtgtggttcccattagggctggctggggtcttcctgaaggccaggccagattcctgagcccctcccccaggacaacccctccctctgcaggcagtttggaatgtcttactagccccatggggtggcctgccagcacccacccttgggaatttccaggggtatccaactctaaataggcctctccacccactagatgatgatgttttgcaatccctcagaggggacaaagggataggagactttaaacctttaacttcccagggtgggccaatccctgaagatccctacagtgtgcctggggagtcttccccatctcccggtcagccacttttgttcaggcctcagcccctctggcctggacaactgcaactgcccccattcaccttctgctaccagtccattcctccacactgcccctgagcgagtgtcctaaaactcaggcctgttattcggattgtttccctccttgcacaacttccaatagctttccagcaactctgaagccattgaagactggtggccagtgggccaaatctagtcccattatgtttgtgtcctgtgtagttagggcactcacataattaaacttttttaaaaatagttgtcaagatttaaaagccaggaggcaacaccaaaatctacatttattaaaaaaaatttttttttggctgggcatagtgactcacgcctgtaatcagagcactttggaaggcgaggtgggcagatcacttgagcccaggaattagagaccagcctgagcaacacggcgaaaccgcgtctttacaaaaaaaaaaaaaaaaaaaggaaacaacaacaaaaaaacatagccaggtgtggtggtgtgtgcttgtagtcccagctactcaggagactaaggtgggaggattgcttgagcccagcaggcagaggctgcagtaagctgagtggcgtggtgccattgtactccaacctgggtgacagagtgcaaccctgtttaaaaaaaaaaaaaaaaaatttaaggcggagtcttgctttgtccctcaggctggagtgcagtggtgcaatcatagctcactgcagccttaattcctgggcccaagtgatcctcccgcttcagcctcctgagtagctgagattacaggctccagtcactatttttaaatagtgcacatcgctctatttttaaattttcttgaaaacactggcaatatgtttgcattcttggatggcaacaagtggctggggctgagtaacaactgtggcctttacaaggtatccctggggcttacctatgcaccattgagggaattctggaaacctcaccaatccctattgtctcccaggtctgaggcccagatgagtgaatggcctttttatcacttaggctggcccttgccttcttattttacttcttgtcagcttcatgtgtttggccatttttgttcctgtctaccccttcctgcagatacttcaatttgttataacaaactcaagtcaaaattccttgacctggtatttgtgtcccttcagactcccttcacacatggttcccctccatatcccagtcaactcctcccctccaacactcttcctgcaggtacatcacacttgccatgcttccccaggctgcagctggactttcacactcccatctttgcacacactgctccttcttcctggagcaccacttctcttccttctctggtgaacttttaaacttttttagagatggagtctcagtctgtcacccaggctggagtgcagtggcacaatcatagctcactgcagcttccaactcctgggctcaagcaatctttctgcctcagcctccagagtaggtaggactacagacacgtaccaccacagctggctaatattttaatttttttttttcagagatggtatctcactgtgttgcctgggctggtccagaacttcaggcctcaaataatcctccctggggccgagcctccggccctggtgaacttttattttattcctccctccaaccccagcccagaagccactgactctggggcatcctcctgacccctgcagaagtcagttaccctcaggttgtccaatggtccctgtgattccagaattctcacaatgtatcccctccctatagtgacagcccctccagggttttgaggaggcctgctctcggcaccccaaggctcactgtgctgaggagtcaggccatcggactggtggcagtgacggttaggggaaggaggcgtagttcagtcctgcaggagctggcctctgagacaaacacaggtttgtcggagtcagcaaggctacaagagagggaggcagcgggcaccttctgtgccacaaggtgaggttttctgggtcctgggcagcacggctgtctgtgtcaccagcggaccggggtgagtggcttcctgtaccagggcagtcaggtgctctctgctaccctgtgagtattctagtgagcagaaatccagaagaaaaaaagaggagcaaaacatcagaactcagggtgctaggcaaaagtgttcttatgagaaaaatgcgacagattatttgagactctgatagcctgggggtgatccataaacattcccgaactcctccaatgccccccagcactgtcatcagacatcttcaccctctgaagcccatgctgctggagaccccaggaaatggccttgataccaacctcccatccccagcccacactccctcttcctggcctaaccattctcccacccgcaggtgttgcttcccagactgtggaatcaaatcctctggatgcacccaagaagcaggtactgggtccccatttaacagatgaggacacggctctgagcgctgcccgaggttccccagccgacgataactccagcccgccgggcccgaagagcagagtcctgcctcctccccaccggcttcagcctcgggcctcggctctgctcctccctcctacacacaccccggacgcgtctgtccaggtccgaaatccagatccacacgtccgtatcccgaggcgggcgtgaactatccacccgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccagagttgtttcaggccagggccggccgcaaccagctccgggcctttaggtcctcaaagttccgaagattttcaggtcgagccagtggcccaggctagggagaggggagctgtacggttgtgcaggttgtgacctatacaaggtgggaggcgtggttgtgggtgagtgggattccaagctcggccttggcaggtgctgactcgttctgaaggagggcagggggcaccgtttctcacaaaggtctcggatgagccagcctggcctgcccttgatttagggctgctgagggtagacacagtgggagagcaaatggctagggttggcccctgtgggtcagggccagggctaaagaggacagggggactctcctggcccagagtagaaacaactggatcatctgggctccctgggcctttctttcttcttgaattcctctcccaccctcaccctgaatcttgttcctctgtctctaacatagttcctaaaacagcccctgcccctgcccccactcaactgcccaagctcctgttacttccctgcacaatcgaaaagactcctgtccgctctcccagggtccccaacaatcagttcacactgcaggcaaagagacctttaaaaatacaaatcaggaaaacaccagggcatgtgattcctcgcttaacagccacccacagcttccctgcaaaggaagcccaaaccttttcccccagcccctacctacacagacagacctctcttcctatccttctccccactgcccagacactgcttacactggctgcctttctgttcattgaacttgataagctttcccccacctctggccttggctttgctggtgcttttcctggatcgctctgcccagatccttcccaggaacgtcaccttcccatcatccctgaccacaataataaagcagccccatctgcctgatccagtctgtcacttaaccttatatatttcttccactgaactcaccacattctgtaattatctttcttattcacttggtttgtggtctgtttcacttaccagaatgtcagcttcatgaacgcggggaccttgtctttcttgttctctagcacaatgcctggtgcaaaccaagaagcactcagtacatgctccatacattccaggaaaggagtccctgggaccaaactggatgctagttcatctggtcacctccgagagggcttctctctgggtggggccagctacaaacacctgtactcacctggtacccacctagatgctttgcacacatgggcagacccatggcttactataacaataatcttggctgacagctaatcagctgactgtgccagacatcattctaagtcctttacatagtttagtttaatttaactcattccatcctcctgtgaagtagacactaatagcctcagtttacaagtagatataccacacacacagatccacaccacaacacacaggcagcataagcattgaattcattattactatccaacagatagatgagtggggtaaagaaatcagggtgagcctgggacatttaataactactgtgggaagatgggaagaacaccagggaaagctcagcatgggggtcaggcacagggccagctgggcaagtggtagaagaggaagttgagcctcagcccacgcccatattctgagtccccacagcacttggagtggtgcggagggtggttcctggttcagttctgctacccaccagaggggtgatcttgcccaccagagggcaaccgtttaccctcttgagaccacattagcaaaatggtgggggaggcgtacataatacctgtctcccagggaccccaccaggatcaaactccaaaatgctcatgaaagccgtgtagggcttgctgatgaaagggtgcaggttgccagccgggaaaactggggctggagctatgctttggctcttctggaaccatagctcactgctgtatgaccctccagagtggggggctggtggaggggctgggtctcaccaaccattgccccctctgtacctggcctggtgctcatctagaactccataggtatttgtggagtgaatgcctgcgtgagggaaggaccagggcataggtaagaggaggagaatgaatacatgagtgagaggcagagtgaatgaagcagggactggagacgccctctgcctctgagcctcagtttcttcatctgtgaaagccagtggtggggcttggcccacttctgtctctgggctccagtgtgaatcagacaagatggggccactccatggaagcccctccttgctatctatgcagggcccccagggtggacggggggagctgaagtgaccagtgttcccctccccccatccctgtcccccggaatttatagattcctcattgtcctgcacaaaggccttcttgaggagggggcggggtgatggaggagacgggagaattagaaaggcggaagctgagcaacagccagccacacccaaggccccataaatctgcccaggcccctgtaagatggactcgctttgccgcacttgaagcggcttgcagggctcctgctgctgggatcagctcaccttcctcacagctctggatcctcagcaagatggggggtggagctgcggggggcatgaagacaagacctggtggtcagggaggggtgactcaccttgcgttatacctctgacctcagaaagtccttaatcttgttcctgtgctgccccctgtaattctagtccacagctgttggttctgagctgaaaaatgagctttttgtgggtactctgagtctttttgtgggagtgggcctgaaggctcagactctaagaaaatggcctcctcccccacgctggcctctgggtagtgggtgggaggctgagggtggaattgacagatggtgcggtgtttaacagatgacgggaaacaaaattactcagctgccgtgtctctccatcttccccatggaaggagatggccttcggactggaaacagacaatgacctcaatcaggaggctgtcagaggacagggaaagagagaagcgacggggtattaggggtattagggcaccatgaacaggtgtacaaaagacctgactcagaatcccatccctgccacacaccagctgggtgatcttcagcagatctcacagagtctctgttttctcatctgtaagatgggtcaatgaaaaaccctgccttatcttcctcactggcttttatgaagattatatggattctgtgtttgaaagatgggctttaaagacttgcgaaggtgtaaagatgtaagaggttatctactggaaactctaagtgccggcccactagttgttgacggaatcattttaaaaactttttttttccttacaacaaaacagaatagagtagaaaacataacagtgctttacagtttcaggaaacgctgcttgtagttacatgtgcattcatgtgtcctgggtccagaagtaaatgtatttactgtggatgacggtcaaaaaagtgaaatactcagagtagagaatattcttcagtgatatctccagaagggaatggtggatgaatggaaactgacaacatgaaatatatcaggctaaacataaatgtaaaaatttttgtaaacaaaaatgtacactggctctgagcagctcagtgtaactgcggttggtggtgatgggtggaagggcttacgtaggacttaactgactgcccttttggtgggcaatgaagctctctctgctgtgtaagacaccttgagcctgattcctgagaatgctgtccctgaacgcccactaggcaatgaccgtggctccctcaccgtggccctgagctgtgccagagggaatgggttatttagcgagaaccttgaactcatgtgcccaggcctcccctccagtccactaggagtgcagaaggatttgcaacaggtatgctgtagtggtggtcaggacacccctgcctgaacttcacccatgacccttgtcctcacccccacccaaggggtcatagtccagtgagggtgagctggtcagagtggaccctaaatcaatcccagaccttcctggctggctctgagttacaagctgtgggctttgtgatgcagatcatgattcgggagtagggggcatgacctatggcaggtcacacaggacccctagaaagggccagagctggggtcagaggccacctcctccattctctgccctgctctgctgggtcccatcctgcatctacctagtccttcagctgggctgggccatttccccactgactgccggctccagctgtaactgccaccaagcctggaggctgggaggagaggggcttctgctggaaaaagatcccagaagaaaagaaagggatgagatgacacagtattttgttcccaaaccagactcaaaagtttcctgagttccttctctgtagatttgcccctgcaccgcccccccgccccccgccccaccaccttctcttctgattgaattccgcaagtcaagactctgggcaaaaatccagcccaaaggattagatggctggagattacgcacggcagtcagagagcaagttagggagcaagcagtgtatgttatcagggcttaagagagagcatcagagggagagagagatggaaagagccagatggcgagatgagaaagatcaagctgaagaaaaggggatgacaggcagacagaaagaggagtaccagcagaagacactgaagagagtgattgagaaataggagcggcaggcaaaggaacatccttgtgaactcctgtcagaccccagcggctgagaggtccaaaggaggttaatccataaagggcctttgcttttaatccttaagaccaccagcctgagactgcagaaggccctggctgaagtgtacctgtgtcatccaggagctatccattattttacacattaaccaacaactccatgccccactaccacaatcatttctatcaacaaaggcatacacagagagggtcaagaccaggcctggggaacttggcaggggctgggaagggatccctattgagtcctcttgaggagggaggcctggacagggcacttcaagacagggcatcaatgcaggtagaaggtagaagaatcctcacacttggccatgtgctgtggctcacacctgtaatcacagcactttgggaggctgagatgggcggatcacccgaggtcaggagttcaagaccagcctagccaacatggtaaaaccgcgtctctactaaaaatacaaaaattagccaggtttggtggcacatgcctatagtcccagctgctcgggaggctgagacagaaaagaatcgcttgaaccttggaggcagaggttgccgtgagccaagatggcgtcactgcactccagcctgggctacaagaatgaaactctgtctcaaaaaaaagaaaaaaaaaatacaaaagtaagccgggtgtggtggctcacatctgtaatcccgggtactcaggtggctgaggcaggaaaattgcttgaacctgggaggcagaggttgcagtgagccgagatcgcgccactgcactgcagcctgggcaacggagcaagactcctgaaaaaaaaaaatcctcacacttggggtacccatccaggttggctaaagctgatatacagaaataactacagaaataactccctttcctttgagccagaaacggaaccccacaaccctcctgtgcatctgccctgccaagacccagacactgcacctgaccctagaaccctcagctatagcctcaagccctgtggggtggggatgctcttccaattcctgcccagacctgccacctgctggctgacagtggcctcgcagtaacaagacccttgctgaggctggggtgattggtgctagaagtagcttctctgggcttggggaaaagaggatttgaaaagcaaaatgtgaaatccccattcacctacctacgtgttcttatggtctctctgcacaggttaaaaagactctgtccctaggccaggcacggtggctcacccttgtaataccagcactttgggagcccgaggcaggcggatcacgaggtcaggagttcaagaccagcctggccagcatggtgaaaccccgtctctactaaaaatacaaaaattagctgggcatatttgcacgcctgtagtcccagctactcaggagactgaggcaggagaatcacttgaacccgggaggtggaggttgcagtgaaccaagatcgggccactgtattctagcctgggcaacagagtgagactccctctcaaaacaaacaaacaaacaaaaataagacttcttgtccctgaccatcactcctgcatgatgctgggggtgatcttcaggccagaggagaatctggaggggaactcacatttactgaatggccgacaaggtactagatgcgggagacacagagataaccaaagtcctgggattataggtgtgagccacggcacctggccaagaatgagattaatgataactagtgtgaaaaacacaagcactgaactgtgtgcctgactcagagtagttttcaattaatagtgattgaatgaatgaattagagctaccaccaagggatgacgaactctgtgtgcagaggaaaagaaggaaacagacagggaaatatttctgattcttttatatatttttttctatcattaccaagtagtaattatctaggtggaagattcaaacattatacaagtttgaaaaacaaacccgctgggcgcagtggctcacgcctgtaatcccaacactttggtaggccgaggcgggcggatcacgaggtcaggagatcgagaccatcctggctaacatggtgaaaccccatctctactaaaaatacaaaaaattagacgggcgtggtggcaggcacctgtagtcccagctactcgggaggctgaggcaggagaattgcgtgaacccgggaggcggagcttgcagtgagtggagatcgcgccactgcactccagcctgggcaacagagcgagactccatctcaaaacaaacaaacaaacaaacaaaaaacctttttcttcacccttctcttattcctcctctttaagttaaccatgttttaaagagcatcattttgtctagaggttccccatctgggctgtacattagaatcacatgaagagatttttaaaatcctgttgcccaggttgtgccccagaccaatagtctcagaatctccagagtgggttccaggcatcactatttctaaaaagtccttaagtgattacattgtgccgccaatgttaagaatgaccattctggccggacacggtggctcatgcctgtaatcccagcactttagaaggccaaggcgggtggatcacttgagcccaggagttaccagcctgggcaacacagcaagaccccgtctctacaaaaaatacaaaaattagctgggcgtgctggcgcatgcccgtagtcccagctactcaggaagctgaagtgagaggattgcttgatcccggggaggtcaaggctgcagtgagccatgattgtaccactgcactccagcctgaaagacagagcaagactctgtctcaaaaaaaaaaaaaaccattccagctctttctatgcatttacaaaaaacacgtaaatagccagactctctctctctctctcacacacacacacgcatatgtatattgtagagacggggtctcactatgttgcccaggctggtcttgaactcctggcctcaagtgtgtgtgtatatgtgtgtgtatatatatgtatacagtatactgtgtgcctgtgtgtttgtatgtgtgtgtgtcattgcatttggctttttttccaaccatgaacaaggtggctcagagagattttcagggcaaaccatgtagatatttatcttcttcttgaagataaatggaggcattgaatggaggcataatctacaggtgcctctaacctttcctctactgatgaacatttaaattgtttctaattttttttactgttacaaacaatgcttcaaggtatattcagtatgtctttttaaattttattttattatttatttgtatttatttattttgcagagacagggtctccgtgtgttgcccaggctggtcttgaactcctggcctcaagcaatcctcctgccttagcctcccaaagtgctagcattacaggcatgaaccactatgccaggcctactcagtctatctttgctcacatatgcaagcactgttttgaaaaagatttctaaaagcagaatttctgggtcaatgtgtatgtacatttgttattttgatagatactgtcaaaatgctttccaaaaatacttcactaatttacattctccccacagtgtaagcacttcatattattaatgtttaatttttaccaaactgatgggccaaaagcaatatttcattgttattttaatttgccttttcctgcctatttgtgaggttaagcatcttttcatatgtttattggacatttgtatttcttttctttttttttttttttttttcgagacagagtttcgctcttgttgcccaggctggagtgcaatggcacgatctcagctcactgcaacctcacctccgcctcccgggttcaagtgattctcctgcctcagcctcccgagtagctgggattacaggcatgcaccagcacacctgactaattttgtatttttattggggatagggtttctccatgttggtcaggctggtctcaaactcccagcctcaggtgatctgcccacctccacctcccaaagtgctgggattacaggtgtgagccaccgcgcctggcctggccatttgtatttcttttatgaattaattgaccatgctatttgcccatttcctattgggctttttattttatttatttatttatttatttatttatttatttatttatttaattttgagatggggtcttgctctgttgcccaggctggagtgcagtggtgtaatctcagctcactgcaacctccatcttccaggctcaagccaacatttcagcctactgagtagctgggactacaggcacaggctaccatgcctggctaatttttttttttttttttggtatttttaatagagacagggttttgccatgttgcccaggttggtctctaactcctggcctcaagtgatctgcctgcctcagcctccgagagtgttgggattacagccgtgagccaccacatctgtctcctattgggcttttttgcaattaattaggaatagaggaaattctatttccaataatatgactggctggattctggactgatttttcagcataagtcatgtaaaaatgctggttgaaatacgcaaattattttaaaagtgtagatgtgctggccagatagcaagaaagtattaggttaaagtctaagggaaggcaggaactcagagaaacagacaaaggaatccttctttagtgtgaggatatttgtcgaattaggcaaacttgaacttcaaatttcacagtctctatttttgatagaaccaaggtgaggaatctaataggagattctctaaaaagctatgactccaaaggattcatcgttcatgtaagattgaacctgaaataaatctatcccgctgtcacatccagaggactttaatgaaagctgcctcagtgctgagctgatagcaaggctgtatctctgagttgtaaccaccagctgatctttgcgcttatttgcagccctggatgacccaaaactatccaagttaggtatttagtttaaagtggttcaggactggttagtacctctacatgcctggcaggaaaaaacaaaacaaaacaaaacaaaacaaaaaaacttcatattctctgaaggaagataccttagtcctcagcctcaagaaatttctaacatcattttctagggaaaataataaatagctcacagggggaaaaaaaatctctaggctgggcgtggtggctcatacctgtaatcccagcagtttgggaggccaaggcaagaggatcactggagcccaggagctcaagaccagcctgggcaacatagtgagacctcctttttataaaacagaaaaaaaaaattagctgggcatagtggcaggtgcctgtagtctcagctacttgggaggctgaggtgaaaggatcacctgatagagtgagataccacctgatagagtgagaccctgtctcaaaaaaaaaaaaaaaaaaaaaaggtaaatcataagaaatccatacctaagcattgaagtaaaacttaagaacaccaaagacaagaagaagaccttgaagacttaagaaaagaaggccgggcgcagtggctcacgcctgtaatcccagcactttgggaggccgaggcgggcagatcacctgaggccaggagttcgagaccagcctggccaacatggtgaaactccgtctctactaaaaatccaaaaaattagccaggcgtggtggtgggcgcctgtaatcccagctactcgggaggctgaggcaggagaatcgcttgaatccgggaggtggaggttgcagtgagccgagattgtgccattatactccagcctgggaaacaagagtgaaactctgtctcaaaaaaaaataattaaatttaaaaaaaaagaaaagacaatctttaaaggagacacactgaactctcaacaagataatgaaagccagaacccagtgaaatactttccacacatcatggcaccgaacaactgaaaaatacacagtcttttaaagcacacatgacgtatttggcaaaatctgatcatatactagattataaagcaagtctcgattgattttaaagatttgaccacagtgctagaaataagtaacaaaaataatttccatatgtttgaaagttattaaagacatttctaaataattcattgatcaaagaggaaataaaaatggaacaactaaagtagtattcaatgggaaatttaaggtctataaggcttatattcaaagacttgaagaaaggatgaaaattaattagctacacacatatctcaaaaaattagaaaataagagcaattccacttgtaggtatacactcaagaatactttttttctttctttctttctttttttttttttttttaagacaaagtctcaatccagcgcccaggctgtagtgcagtcatgcaatcttggcttactatagcctcaacctcccaggcttgggtgatcctcccacctcagcctcccaagtagctggcactacaggtatgtgccactgagcccagctaattttttcatttttagtagagacagggcttggccatgttgcccagtctggtctcaaactactgggctcaagcaatctgccagctttagcctcccaaagttctgagatgacaggtgtgagccactgtgcctggactcaaggaatacttttttttttcgagacggagttttgctcctgtcacccaggctggagtgcagtggctccatctcggctcactgcaacctccgcctctggagttcaagcgatactcctgcctcagcctcctgagtagctgggattacaggcatgtgccaccacgcccagctaatttggtatttttagtagagacggggtttcatcatcttggccaggcttatcttgaacttctgacctcaggtgatccgcctgcctcagcctcccaaagtgctggaattacaggtgtgaaccaccacacctggccatcaaggaatatttttccataaacaaccatgcctgtgtgttcatagtggcagaatttataatagcagaaacttggacacatcccaaatatccgttaataagacagtgcataggctgggtgtggtggctcatgcctgtaatcccagcactttgggaggccaagatgggtggatcacctgagatcgggagttcgagaccagcctgaccaacatggtgaaacaccgtctctattaaaatacaaaattagctgggcatggtggcgcatgcctgtattcccagctactcgggaggctgaggcaggagaattgcttgaacctgggaggcagaggttgtggtgagccgagatcgcgccattgcactccagcctggacaacaagagcagaactccgtctcaaaaaaaaaaaaaaaaaaaagacagtgcataataactgtggtacatcaacgcaatagagtattatacagcaatcaaaatgagtagaccatagtaacacaacaatgtgaatgaatcttagcaatatgatattaagtgataaaagtggacagcaaatgactacataaagcattatatgcttctaaataaaatagctaaaattgtatatgtatatatacataatataaatactctgaagaatacatgaagaggtagtaaaacaatatataaaggagagcaaaagaataatggacaagagactaggattatagctgccttggatgaggagaggccggggctatgtcagggaaatcatgttaaactgtaaagtgttatcaagattgaggccaggcgcagtggctcacgcctgtattcccagcactttggtgggattgactcacagttccgcagggttggggaggcctcaggaaacttacaatcatggcagaaggggaagcaatcataacctttttcacagggcagcaggaaggagaagtgccattcaaaaggggaaaagccccttataaaaccatcagatcgctgggcgtggtagctcatgcctgtaatcctggcactttgggaggccaaggcaggcagatcacctgaggtcaggagttcaggaccagcctggccaatgtggtgaaatcctgtctatactaataatacaaaaaaaattagccaggcgtggtggcgcacgcttgtaatcccagctacttggaaggcaggagaatcgcttgaacccaggaggcggagtttgcagtgagctgagatcgcgccattgcactccagcctgggcgacaggagcaaaactccgtctcaaacaacaacaacaacaaaaaccccatcagatcttgtgagaactcactatcacaaaatagcatgggagtaatcgcccctatgattcaattacctcccactggatccctcccatgacaggtgggaattacgggaactataattcaagatgagatttagttgggggacacagtctaaccatatcagtcctcatatggtggaagcggtgaggcagctctctggggtctttttttataaaggcactaactaccccctaaaaagtctcaccttctaataccatcaccttgggggcttaggatttcaacatatgaattctgggggaaacaaacactcagatcatagcgtatcccatgttcagggaggagagaagatctaacattatgaggcagtcaattttccccaaattactctataaattcaaataaatgcctatcaaaactgtagcaaaaattttaaaagaacccaacaatcttatatgcaattttacatgagagaataaaaatcaacttcaaaaaagaaaatcagatatggagaacttactctatcaggtagtcagagagactacaaggctagagtaataaaatcagtgtagcattggcacaggaatgccctcataagatgctataagataactgaaacatagcataaaacataaaagagaactcaacgtttacatgtgataaaaacgacaccacaaatcaagggagagagaattgtttaatagatggagttatcttgctaaatggagaaaaaaataaggttggatcctttattagtctgttcaggttgctttaacaaaatacacaggctggatgggttacacaacagaaatgtattttctcacagttctggaagctagaaatccaaaatcaaggtgtcagcaggattggtctccagagaggcctctctccttggcttgtagatggtaccttctgactgtgtcctcacgtgtccttttcttgtgcaggcacagagagagagagttctggtgtctcttcctcttcttataaggacaacagttctattggattagggccctatcctgccctaataacttcatttaaccttaattacctccttaaaggccctgtctccaaacacagtcatttttggtgtcagggcttcaatatatgaattggggttggttgagggagacacaatttagtctataacagattatttcttcaatattataaaagtgaattccagatgaattaaagactaaatattaaaaataaaactgcaagattaataaaagaaatgaagatctttgtgatcttggagtagaaaattcttagtaaacaagaccctgaacacaaagtataaggagaaattctggtgaatttaaccatatcaaaattcaggagctatttcaatgaaggtcaccatagataaagctaacagaagggtttatatagtacagttgcctcatctataacccatctgacaatggctttattatctagaatattaaaagaattcctgaaaaatcaataagaaaaggataggaaaattcaatagaatactgagcaaaggccatgaacagtcaattcacaggagggaaaacaagattggccagcagggcatgtggagagatgctcaccttgttgataatcagaaaaattcaatgtaaaatagcaatatcgctttatagttctatcagattgacaaacattagaaggctgaataatgacatgtgttgtctaagacgtagggagactcttatgcactgctggtaggcacacatggtgaaacagagtgcaacctgagtatccactcagtaagtgtgtatgtgccctgtgatctagtgatctcagagaccccgatgggtccacaactagatacgtatgagggtgttcactttggcattatttatagtgacaggaagttggaggcaacctaagcatctattgcaggaagaagggataggctaaatgaggtggatgcacactatggaattctataagcaggaagaaagagggaagaaagagggaagaaagaaagaaaaaaagtggtgcactctacatctttcatcaagacagtgttaattatagtgaaccccaagtttctcttcaaagaatcagtatgtcagtatgttcagctctcttattctttgattatccattttaaagtttagcttcctggttctcttccgttcccttgctcctggttttagtaaacaactttccctctagtcctaatcagtagttcacatctgttctctggtcagctgctccatcctgactcatcccgtttatctgctttgacctgagtcatcccagtcacctgctttgacctgagtcaccctggtcacctgctctgatctaagtcacctttagttccctgttcctaactgtccttcccgccaaactacccaccccgccactctaactcatatccctgctctctttaaaatagccaatcggaattagcttaggctgtgcggtccaaccctagccaataggggaacgccacagcagtagggccgtgtgtcaggaataagaactccttctcctctcctgtccaggtgtgctcttgccattgttccattcacgactcgcacccttctatagaagtaaaaattgccatgctgagaaaattaaatttatgttcgagtgctatttccttgcagcattgaaaatttatttacaacaacagcatgaacttttttcctagaatccctatccatcagacttctgtttgcatttcattggccaaaactgcattacatgataacacctaactgaaaggtaactagagagaaggggagttatgaacagggattgtgttagataatcagagatgtctggtttatcatctgatagatttttttctaactgctgtatagaattccatagggtgcatctatcccattttgctgtgatggctagaggtttagcagccatcttgtgccaaggaggaaaagtcaagagaatcccagagaaggccctgacaagtttcttaaccaacatcaacagtttcctattcctgaactttttatcatgtattaaaaacaagcacctctttgtttaagctacatgtgtcagagttcaattgcagacaacagaaataaatctggacctggtgcagtggctcacgcctataatcccggcactttagggggccgaggtgggctgatcaactgaggtcaggagttcaagacctgcctgaccaacatggagaaaccccgtctctactaaaaatacaaaattagccggggtggtggcacatacttgtaatcccagctactggggaggctgaggcaggagaatcacttgaacccgtgaagcggaggttgtggtgagccgagatcgcgccattgcactccagcctgggcaacaagagtgaaactctgtctcaaaaaaaaaaaaaaaagaaagaaagaaagaaagaaagaaagaaatctgatcagtttaaacagaaagggatggagaagcaggcttaggtccaggaacaacccccagctttgagagtcacatgacctctgcctgtgattgagaaaacaacagtcactactacaggaagctgatgaatcaggaagctgctcaccagagccttgctgctgctgccatgacctgtgacagcaaaacggatgtcccatgctacgtagctctgttccaaatttatatcttgcacaagagcaggacgcaaaccacagagtcatagctcaagggaatctgggaagggttgttttagctttccaacttctgcagcgcagaagaaacactgaaagcagttttagattaatgttgaggagcccgtctattatggacaacataccattcagctttttggttactaaaaaccaaatgcacatccaactgatacactgcacctaaagcaataaggatggagcttaagtgaaaaagaaaaaactaacagaataagttctatagcacaattcataacatgttagttaaaaacacatacaagcagagcatggaggctcatgcctgcaatcccagcactgtgggatgccaagacaggaggatcacttgatgccaggagtttgagaccagcctgggcaacaaagtgagatccccatctctacataaaaaagttagacaggcgcggtggcacacacctgtgtgcctccgagaagctcgtagcttctcgggaggctgaggtgggagaatcacttaagcccaggagtttgaggctgcagtaagctatgatcatgccactccactccagcccaggtgacagagtaagaccctgtttctaaaaagaaaaaaataaaataaaaacacacaaatcagtactatctttttcaatgaaatgtacattttcaaggatatacaagtgccagttggtaaagggtggaggagaatgggatgtggggattaagggtgaaagagagaaactaaagaaagtaaaacaaaacaagagagaggtcttgtacagtctgatgatgggagtgataccaatgggggaatatcattggctccattttctacatctgtggaccaagaccaatccatcaagcttaatatgtaatataaatattaaagaatattttgataacaatttatcattatattaacagatcatttaatttaaatatttcatatttaatttatcacactgaaactaatctattaaatttcatacatcataatttctggccaatccctccctcactactgcctgccgcactttgtgccccgactgcccacctgcactagacacataatgtcggtactcacaatttcgtttgtttgtttgttttgttttttgagaaggagtttcgctcttgttgcctaggctggagagcaatggtgcgatcccggcttactgcaacctctgcctcccgggttcaagtgattctcctgcctcagcctcctgagtagctgggattacaggcgcccaccaccaagcccagctaatttttgtatttttagtagagacagggttttgccatgttagccaggctgttcttgaactcctgacctcagataatccacccgtcttggaatctcaaagtgctgggattacaggcgtgagccaccccgcctggccacaatttttttttaaaaggaggtctccctctgttgcccaggctagagttcagtggcgcgacatcggttcattgcagcctcgacctcccgggctcaagcgatcctcccacctcagcctcctgagtcgctgggataacagacgtgagccaccgggcccagctctatactcataatttgacaattatgtttttatttccccagaacctcaaaaaataagttcaggtgacccccctggagaccccaccccagggtcattctgagagtaccaaccctatttaatgagatacctgcattcactcaccccctctcccgcaaccaccccttcagcaagtcgcgctccacccaattaggaggggctttaggctgggcctaaaaagttgggccaagaccccacgaggcagcatctccgccggcgtccccaaggctgagagtgggcgcgtccgtcaggaggagtcgtctttgtgagcccgccccggcggggaggagctgcccggctcaggccccgcccacccggaggatcttggggctggtctgagtccgctcctgagacgtgaccacccgccccgcatggggccccagtcccagctgcttgatccggctcagccccgaggtgtttgcagcagctctttatgaaagtccagccatctgttacctgcgttgcttcctggggagggatagtccacctggaggcattcggagacccagtgattgtgctccgcggagcctgggctgtgccccgcgttgactgcctcatagataccctacgaaccccaagtaagaaaaaacgacgaccctctctccgtgagtctcactggggtgctgacctagagtgaaccctgcttgcttagggctcctgacccagcgcttgtcctttctcagggtggatggggcgagacccctgctgggataaatgttttccctggggcaagggctgtgcacttcgcagctgctgggtcccctccctaggatccagggagacactcactactcctctccattctgtgttttagatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggagggtgagatgtcctggcttcccagaacagctgggggcatctttgcatccccaccacaccgtcctggcctggctccctgagaggggttcaggggcaatacctcctgcagtcctaaggaggaagggaatggttaagggcgggtcttcacggggtttggggcaggctctgggacagatatgggtttagagggtgcaaggggccctggagtggcccagggggaaagcaggggatctgagctgcccctccctcagacaggcctcatggtcgcatgctaccacggcttccagagtgttgtggccctgctcagccactgtcctttccttgatgtgaaccagcaggacaaaggaggggacacggccctcatgttggctgcccaagcaggtgtgaggctgctgcaccccacttccgacagcccccttttgatgcagacagggcctcagccccacccttgttgcacggtgttctacaccagactctgtcatgctgggtggagggcggtttgggagcttcatcaccccctttcctggggaccaagcttacccttgctgccctgcaggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgtgcggggcctggaccggggtgtgtggcctccagtccctcctccaagccttcccaccagacactaagtcagctgtgattatttgcagaaaggagagaggtggagatgggggatcaatctagttcaccttcctggaggggggggcacatgatttgggcttcgtacaatcaaccaagtcctgctattgatagctcagacattgtgtgtggaggtcccaggaaggaaagtgtgggaggggaacctagcccagctggaaaatctaacacgaaaaaaggctggcatctggaaccagcccctgttcctagctgagtggcttccctctttgggcctcaccagtattgtgagggtgttagctttccctgggactacctccaactctgacaagccaggcttccaggggatccagggaagtgtcgttgaggcctgtggctctgtggggtcgttcagggggaggtgcggtgaagtccacattgtccatggagttgtttgggggcccttcttccccgcagtggggctgccctctgctggtcactctgggggacccctgcctccatttttcccttccccacacaccccactgggtttggagtgaaaaaggagtgaatgaaaaaggagggcgctctacaccctttcttttgtcttagagtgactgctcctcccacaaccccaagatgggagagggagatggtgagaagagaagaaccaggagagggaaccagccgatcatccccacccacctgccccagagggtgcagctcaggcctctgcctgtcctgggcagcctgcaccgctgctctgctcagctccttggattgaggagatccctattctgccctaggtggagccccacaataggtctctctgaagtcttttcccctctctggacctaagtgtcttaatctctcttaaacaggaggttgcaacactggcctccctgattccaccttcaacaggatgggactctatggcttcgaatgtaacccacatcagtcttgctcctaaagaatctgcccttccacaaatcaccaacccctatcccgccccatgtcaccccctgtgctccttcccaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttaggtactgccccgccccctcccctggttccccagtccccgccagggagtccccagaggtccccgtgggtcttcgtcccctaccagagccctcagggcatattgagcaagtgccttcagtggctacaacccagggatagcaccagccccaggccccaagtccccaagatcctcctctccaaggcatcctcatcctcccaccagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggagtgcctccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtggaacagtgtatatggcatattattatttgtcgaagtaaaattttcacgaagataaacatgactaagacaaatatatagcgagtactaagatttatttaactacttaatgagtgaaccagcaggatagatcaaaaaaaaaaaaaagaaaagaaaagccattattgacaatcagtgaaaaaatgaatgctagaataagattgcaaagttagacacaaaaaagttaattgacacctggcaataaagccataaccatttttatttttttctactagaccaaaataatttgccacttatcaatctttaacaggttaatctgtctttttagagagcctgggtccttatcaatagtaaatattaatagcatgtcaaacaaagttaacttcccctagatgacccataggtggggttattagccaatgatctaaaatatatttgaaagggcactaactttattttttggccttatttacaagttttggatatttttctcaaacttttgttgtgtaaatatatttgcttgtatgtttataataatgatagcaactacttagaaggtgcttactatttatagtaacacatttaacccttccagtaatcctgaggattttatctttgaggatatgaggcacagagaagctaaggaattgcctaggtcccacagctagacactggcagggctcaagattgagatctagccatccagtgtggcctccaggctttaacgctaacccccaatgcggtactggagcatccctgggaagaacacagtagtgttctccagaaaaggactgaacagatttattcagatttccttaatttttttttctttttctttttcttttttttttttttttttgagacagagtctccctctgttgcccaggctggagtgcagtggtttgatctcggctcactgcaacctccaccttctggattcaagtgattctcctgcctcagcctcccgtgtagctgggattacaggcgtgcgccaccatgcccagctaatttgtgtgttttcagtagagacagggtttcactgtgttgatcaggctggcctcaaactcctgacctcaagtgatctgcctgccttgacctcccaaaatgctaggattacaggggtgagccactgcacccagccctaatgtcccttttctatcccaggattctatccaggatcccctgttacatttcatcatcacatcccccagaatcctcttgactgtgacagtttctccgatttcccttgttcctcatgatcttgacagttttgagtcatattggtcatgtattttgtgcatgtctctcaattgaggtttgtctgattttttttgttgttgttggtggtgtgtgtgtgtgtatttttgatagagacgcagttttaccatgttgcccaggctagtcttgatctcctgagctcaagtgatccgcctgccttggcctctcaaagtgctgggattacaggtgtgagccaccatgcctggcctgtctgatgtttttcttataattaatgtaagactgggtctttgggttttcagaagggaaaattccacagaggtaaagtttttctcacatcatgtcaagggaggcatatagtatgaacatgacttatcacttgatatagacctcaatcacctggctcaggtagtttgtcagttttctccactgtaaagtttctctttcttccccctctctgcactgtcatctttggaaggaagtcttatacaaggtccacactaacagagtggggagttatacaccatctccttgagggtagagtatctagataaattatttggaattccgcacagggcgttttgactttctaattatgtctaccaaattttgaaacattaaaaaataaatccactctttgaatagggaaaatacacccccccaaacacacacacacactgagaagaaaatgactaatagggtcagataatatatgatttctcccagaagagctctgaaggccactatggtggactggaagggactcaagggtaacttgatcctgaataaggcacttaaatttctcttgcctcggctttcacatctgttaaatggagaaaatgggggctattggaaggatccactagctagtatgggtgaaagagttccataaactgtaaagtactatcaagaggtgacgtattaaggaagagccccggggaagtgagttggattaaacagcttcagggcctccaggatggagctagatttctttcctccccacccactgctgaaatcatggcataggaagccagccttggcattggacatcatagacagagaaagaagctacatcgatagtcgtggatcagcatcgtggcaaaatgcctccctgggagttggcctgtgaccttggacaagttacttacactttctgagcctcacaggtgtcacttgcagaatagaggtaagagtaacatgttcaccatagggctgttataagaattgaatgagatgacgcagcacttggcatcatacctggctctatctatctgtatctatatctatatattttgagatatggtcttgttctgctgctcatgctggagtgcaaggttgtgatcatagctcactgcaggcttgaactcctgaactcaaaggatcctcccgcctcagcctcccaagtagctgggactataagtgtgtgccaccacacctggaaaactttttaatttttttgtggagataaagtctcactatgttgccaaggctggtctcaaactcctgggctcaagcgatcctcctacctcagcctcccaaagtgctgggattatagttgtgagccaccacgcctggcccattttcttttctttctttctttcttttctttttttttttgagatggagtctcatctctgtcacccaggctagagtgcagtggcttgatctcagctcactgcaacctccgcctcccaggtagctgggattacaggcatgcgccatcacacctggctaatttttgtatttgtagtagagatggggtttcaccatgttggccaggctggtcttgaactcctgaccttaggtgatccacccgcctcagcctcccaaagtgctgggattacaggcatgagccaccgtgcccggcctctgttttcttatttaatctgcacagccttcctattttgcagttgaggaaattgaggctataaagtttaggcaacttgcccaatgtcaccaattggtaagtggcaaagcagtgcttggagctcaagtctgtgagattccaaagcctgcgctcattccactgtagcacatggcatctgcttgcagccagggaggattaaactttgagcctctgattctttgagcctctccctccacctccaacctgctcagggacgactactgtaccttcaaggccagggaactagccctctgtggttccctaggcccctctgtcctggccgtggtggatctggtggaacccacattaatgcctgggttccaggttggagcatgttttccagcagagggagcctctctgccttggagaagacccacccttccaatccctggccatctccaggacagctagagtccccggacttcactctagcaactccccctcccatgccaagccatttctctctaatcctctaataggtcctgacaatagccttccctccccctcccagaaccctttcaggctgatcagagagagagaagccttgaggcctggagttgctgtggcctgtgcctcccaaagtcaacctctcctctaatatccctgcctccccctccctcatcacagctcctgaggcttccgaactcagtccctgtcagcagaggccaagaaatccatagtgaggcccctggctgtgcagaatgcaggcacggcaaagcctttggagtcagacagacctgggtttcagtcctggctctgcctctcccaacctgagtcacctcatgtgtaacatcaaatgatgagaccacaattgctgccacccagggctgtctgtagcccaagcagtgaggggtctgagaggcattgggcaccgcctggcacatggtcagggcatggtgggtcaacagcagcctgggattgtacctgagcagcagtgagtaagggaacagcccagggtgcagctacatggaggaggctggcggatgtgcccttgaggccccatggcctcccctgtgattctaggaaactattctggtggcccaggaaatgaaaacacacatctctgcatcccccaccctaggcccactcccagcccacctcatcaccacagtgctggcggctggaggagctgctcccggagtgtacacatgtacaccctccacctggaaggcagagggctcctatacctgggactgcagagttggctgtcccgacacacactgggatgtcagccaggcttgtgtggactcctggggaagcctactcactcccgtgtgggcagggaccatgtctgtgtccctagcctctggctcagcatggaacccatcccaggctcaaaacatgtgcatagggaagaaccttgttcaggctcctctaaggtcctggatgctcagggggtcctttatcatctccctccttctctcaggggccgctcttatccatggactggcagtgggcattccagggcatgccccaggaaaccccttgccaggaaaaggcaagggagtacatatatgtagggaggacagaggacagatggggactcactggtctgtgtcctcttttctccatactggggaacctggacaggatgccccctctccagcagtcacactttccaagtggttgggaccacacatgcgtcttctaccacatcaaccaccaggccagccacacccttaccctggcccgtctggaccttccacctatcagatctcagctggtcacaccgagagagacctaattggccacagctcacacagaagtttacatctgctctcctctctcctttcccacagggagaccttttcatccctaaggaaaatacccagatctgaaggagagggcttgaggacaaggtttaggccctcctcaacaccccagctcctgccaacttctactccagatggttagagagacacatgcagacaagccatcagcaacgggcttagaggcacagacatctacacaggcccattggcccacaaacacccagttgcacgtaacgaggcttcacatgcaggcacacatatacacacttgttcacacaggtgcacaaacactcactgaccaggaaaaaataaaaacagggcccccttttccctagattcctgacccatgccctgctctgccccctctgccccacaacaccgcatccattgccccagccatccagctccaaaaattgcctgtgtgactggttggagtttcatggtccatctatctgagcaggaattggggtgctaggggggcccaggccctgcctttaagtcctcccttcagagcttggtgtcctccttaactgtgaaaggccatgatccctccaagggagagg

SEQ ID NO: 566 - DNA, 59618 bp, Homo sapiens
ccaaagcatttgataagtgtatgagaaatgatggtcaattacagtataggctcattttggaaatacgaaggttcccagggagctgtccagggtgctggactctccttaaagctctcagactcagtgcatgagaattttccatttctctgtcttctaatttcttcttctgtttaacctttttaaataccagcctctaactactctgctctacccttccatactcaatgtctaactgctgcctggtgaatttgtggttagttggcccttaataactagtgatgcattggctatttttgacagtaatttttatttgctatccattctagctattcgctagtctggctgaatccttgggaaattcacaacactgtcatagtcttcaattgcttgtgtcactgccacctctagccattaagttgctctgttttgtagaatggtagaaaaagtcctccggaaaaatgcaaggcagcagagaggcccctccctcaagatcctaatagtgtcagagggaaactagaattagctatgtaactaggggaaattttctcacatcatttatctatactacatttactattctttgtttttacaatatctattgtaacagaaaataaataattgaccagtctgtgttttgttttctttttctttcagtatttgcagagaaataactgtaaaacattttacttcattctattagaaatattgaaaggggatgatgcagccatggcagaaaaaggcattattcccctttaagagaaatttctctcagacatagaaaaaatacagcagtctcctattatgagttgaccttggagccaagaagtagtagttattccctccatccattccattactaatacagcaggcaaaagtcagaaagattagtttcaaaatttctataaactcgaagtaaagtttcagctgtcttcctttatctgacagtgtttttactggtggtacttttaagacttaaaccaaccataggcaactattttctcttcttgagctttatgggcatcttttatagaaactttacctagctgtcagtctattaactcccaagtatttagtttgattcatcggattgcggatatttctaaaaggtaccgcaaaaatacatgggcctgagaatcctcaagggggttggattccagtgagctagtgaaggatcttcaaggtgtttattgagcacttattccctggactgtgcatgatgctgtataggcattattaagttaaacctgacaattctctaagttatggacttagtatgtaattgatggtctctgtcttcaaagtggaaatacactctccactgtgtttatgaaaatcactaaatgactgcctggctgggtgtatgcagtcggtttctctctgattaccagtgatagattatcatgattaatcctcaccatttcccattctcctctgcaccctcccccaatttttatgatgaaaaccatcttcatctgtttgtgctgctataataacatacctgagactggggaatttataaacaagggaaatttatttctcacagttctggaggctgagaagtccaatatcaaagtgctggcaggttcagcatctggtgaggaccctgttccctgcttccaagatggtgccttcttgctaatcctctggaggtgacaaatgctctgtcctcacacggtaaaaggtggaaaagcaaaaaggtctaagttagttccctccagtcattttataaagcactagtggggtcccaaaatgccactttttattttttttgggatggcgtctttctctgttgcccaggctggagtgcaatagcgtgatcttggctcactgcagccaccgcctcctgggttcaagtgattctcctgcctcagcctcctgagtagctggaattacaggcacccgccaccatgcctgactaatttttgtatttttagtagagacatggttttgccatattggccaggctgatcttgaactcctgacctcaggtgatctgccctcctgagcctcccaaagtgctgggattacaggcgtgagccaccacgtctggcccaaaggccactttttaataccatcacaatgaggattagatttcaacagtggaaggtggaaaagcaaaaaggcctaagttagttctctccagaccttttataaggcactagttgggtcccaaaaggccactttttaataccaccacaatgagtattaaattttaacataaattttggaagggacataaacattcaattcataaatcaaaggcagatattatgctcctttgcttgaacaaatagccagtctctggcaatggaccattttctaacttgtataaagctggctggcccacataaggattcaatctataactcatacttaacttcttgatctaaccagctaaactattcattatagttaaaaaggcaatacacaatagaggaacatactcactagtttctaagttttaataatttttaatgccttgactagatcaaactagtaagatacagagcctgcattcgattccaggtttgctgaattccaatgttgtacagctttaaaaagggaattattgcatgctttaaaatggtgtttctgtctcactgcatgtggtgagtgatgaatcactgaatggatgattaactgttctgaatggtgcggtttattacacattgtacattgtgtgctatgcaccactaacctgcataggatctatgtgtgttcttctgaatattgaaaaaatgaggaaaatggtactttctatctgcccttgaggatgttatgtgtgttaataaactagcatctttgaagaaaagatccacatgcaacgaccttttcacttgatagcaagaagtctgaattagtgaaaagtcagaataagtgattacttggaattttaaaaaatcaccttcaagaacattcagtagtgaaaacaaagatttactaagtggattgatgggtcttttattgaatatataataattcttaggaaattcctatttatatgaattataagtgagtaggtgctgcccaagtgcttaaaagccgtttgttcttttaagaatctttaccattccttctaagactttggagcgtttggtgatgtccttaacaagccattgtatatagcagaggagtaaagtggaatcacacataaatggtcacatatttcaaatatgaagatgtaaacagtttagggtctactctgagcacctacttagtgtagtagagctgagcagttgaagtcatttgttctgaaatcacataggtctaatcctgaaatcccctcttaaccatgtgactttggacaggttacctagtatctctaacatcacctgtgctcatttctaaaatggagagaatactgattagacatatcttatacgatttgggggctactaaataagataatgcatgaaaagtactatgaatcatatttacaacataataaagatcagctgcttctattattaatattaacactattaaggagtaattttacaaatgatgctctctccctgtgagaggttatgggtaacaactgagtctatatttgttggcatcataagaagacaactccatatatagtattctgcccccggatttctgcttcttgtttgaggtgggagcaaagaaatgacaggttcaatccaaaatatctttgagttgttcagctaaccgtgggattgggtgaaggatttaggaaggctatgttttggatctgaaataaggggatttcaagactcctgtatttactacagaatattccaaacttttgcagctaccttgaaactatgaatcagccaataggaagaaggggccccaggtaactgctgtagaaacactgccggctttcgccctgacttcttttctgctcactgcagtagcaacttagcttcaaaatgtcctctttagtcatgcattctgatcaaagtagttatttaaagattgtggctaatagtagagtagatacccctggtatttcccagagcagagctcgcattctgggaatcttaggtccatgtgacttcctgagtcagtgattcacactgagaaaagagataggtttggcatgacacaatctgcagattcaaataaatcccctgggagaggatgaggctgctgagagtcctctttgctggctgaagctcccagtgtatgcacaaaacaccctgtcccgggccccagatgtgtgcaggtttctaattgccggtgctgcactaagatttgaagggtgagagagttgcaaaatcacgaacaccgagggcggtgttaggaaggcagcttcctgcacactgttgtaggtgttagtgagattatcaattgctccgggagagacacaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactccca

SEQ ID NO: 567 - DNA, 60398 bp, Homo sapiens
aatttcaccaagagaacaccattctggttaagaaggattctcttttaaaccaaatggaacttctgggaggctccaggctgtcagccagtcacacctccaggaggattagcaaggctgattctccttctccttcccacctgctcgaggtgagctgcatgggccactagaagtgttcatggaggccggggaaagcgagtctttggggctgggaattgcccaccacaccacaccccacttctcactacatgtgagctatgttggagcaggtcagagatggatgtcagctcctgggccctgggggaagaaaggagtaagggctgccctgtctgtgtgcttcccagaggccactgcacactgggctgggagctggatctccattgtctcattcagtcccctcagcaggctgctgggaggattgtggtgtgagcctgttctacggtgagacatactccttcccttctcccctttctccacttcactggctgctccaggtaccccaccccaatagagcctgtacccattagtaacctgggtaaggcaggtgtctgaagggcaacctgaaagactgacccacggcttgcaggggtctctgagcccactctagccagcccttccccctcccatgactcaggtattgcagggagtgagcactggcctcagagtcagcctctgagatgtgggacaatgtcttgatctgtttcctccattgtgaaatggggggtggagaggcagcatccccctcacaggctggcctgagggcagtgaaggagaggtggaactttcctgactagctagaggggccacccatgcaggacccagggcaggctccaactcgctcctagagactggctaggtgcagtggcctgggaaagaggtgggggggctgctctccaggcccagaaggacccaactcatttgacagaggactccaaagagaaaacataatcctggagctgcctgcggggccccagaagagctctgccttgcaggaatgagttccctgtcctgccctgaccagctgaccgtcactgaaaatacagtcccaaaccacagcttcccaggatgtcctcgcctgacccctggctgctctgacctgtgtcctgggacatctgtcaccagcctctcctctgctaatagagggaggagcaccagggccctcccatgacccccccagcccaccctctgccacttagaaactgccaggcaagtctcatactcctgcttcaagtccctcctgacagcccactgtgcccagacgtaacttggtcttgagccacattcttcactgtccccgggaatcttaagaggagaggtaggaatctaggtgagaatcttaggaccctctgggagggtccacagagacctcagactcaacatgcccaaggaaaacatctccacctcctctctcccgattccatctcttcagctaggctggaaacctaggagtccctgtgtctgtctctccagcctccactcatctagctggccatgaagtcaggttaacactctctctaaaacaacccacagctctcatgttccccaccacagctggccccacctctgaattctgcctctgttctctgccttcctaatccttcttctgtgtggctgctagggtggtctttctgtctaaaacagactcagcctcctaccaagcacagagacgatgttaacccttcagcctggcaccagaggtggatgagtctgtccttccttccagcttcgggccctttccagctcctccagtcacatcagcccattctctctgaggctgttcctgtctccctctttggtgccccgaagcatgttccaggcacttctgcccttccactccaatgcccaatttagaggtgacatcacttgttaactgggttcccattccctccgctgctcagccagcccctgtctgtgagccctggtacaagtggctctctagccctttctgcagctctctctctaccctgacctgctccttcccaaagtcccctccctcagaaaacattccctgacacacagtggtagaaagagcagggccactgggaacgaggatgacctggactttttaatgatagtcatgactttttgtcagcaattactttttaaaaagatgacttgctttttcattgaggaacagggatttgcagttgactctgcgctttgccctgtctgaagtcagttcccctccctgaggctctgtttctagcacacaacgcagcctcacacctgtgcactcagtgatgggcactgcggggagggcgcaggtgctcagtggaggccgccatggactgtcctctgtccacttggggtggccctgtgatctggggctggtgaggtccttccagtgcctgtctcctcttgggtctgcatctggggctcctctttgcctgggacttggccctgcatgggcgagagatggaggatgaggccagagctcttcaccactttcagccttaggcccctttcgcagtctggaaaacctatgacctgttctcaaaaatacttcctcaatgcataaaagaaaaatacatggggctacaaagggaattaataacattggccaggcacggtggttcacgcctgtaatcccaacactttgggaggctgaggcaggctgatcacctgaggtcgggagttcaagaccaccctgaccaacatggcgaaaccctgtctctactaaaaatacaaaattagctgggtgtggtggcacatgcctgtaatcccagctacttgggaggctgaggcaagagaattgcttgaacccaggaggcagaggttgtggtgagccgagatcacaccattgtactccagcctgggcaacagagcaaaactccatctcaaacaaaaacaaaaacattggaatacagttatctgcaggaactcctcagggtcatggaccacaaggctcagcccaagagcctagagtctcttggagggccccacacttcccctccccgtagccagttttaggatccaaggttgacttgagtctgtttgggtggcatgtggcctccaaaaggcttaagctttaaagtctgggtgatcctgtgtgccctagccccaaatatggccccttcccgtgcatgggggtgggagagagacatgcccccacagggccaggccttaccaaaggcgaggaaacaggcccaggcagcccacccaggagtccccagcagctgcctcagcccctcctgccctcttcccagccctgggggggctgagccgagtaactccagctatgcagcccggccggtccacctgggtgtgagtgggcagggctgtcctcaagggggtggccccctacacctgcagggccacaggaacacagagggaaaaagatactggggggagggtgctaggaaaagactgagcaaccacagcagctcctgtctgcctgctcccatatgggattctcaacacaagccaagtccggccctgagtgcttcacacacatcagttcatttaatctgagtgaggacgttattcccatgttgcaggtgaggaaactgaggctcgattaacttgtctaagtcaccaagctgggacagatgccacccccagcagtcttgctccagatacttctctgcctgccacagcaggtggtggtgttcccatcgaacagctgagaaaactgagggagcagttcattcccaccctcttcctcaacctcccctgctcccccagccctcctttcttgaaccccctcccacacttagccaccaaccccggagcttagcatatctcaaacttgttctcatgggaccagataaatccctgcccaggtctgagaggcgctggcctcaaggctaggacacaggactctggttagggtctcagccagactctgcagagagtgatcagaaaggactgcaaggctgagactgtgccagaggagtggggaggagaaaggctcctgaagaccagatctctgcacgaccgtggcggcccctgcagctctgcacagcccctcctccccttttcctcaaaagaagcaaatcctccatgaaagatttttggcttcacagaaggacttggccccatctgagaacacgtgagccatctctagaagtgctgagtccccatcagtggaggcactcggcaccagagaatgcctttcccgggaggggcactgctgggcaggtggaagggctctcccctcctctcccctcctctcttcttctctgatatctaatgatcactacaaactcaacaagtcccagaatggactcctgacctcctcctacctcagcctcccagctgccttcctcattttacgcagctccttttttctcaacaaggggctcagtccccaaaactcaggcctgaggagggccacagtgtggaagacgatggtaaaagaatggccagcccatgccggacacagtgtgcctggaaaggaagccccttcctagaggagtgaggacccagccactgatgaaatgctgtccctccagagagcaaggaggaaggtgcagtttctcctggtgtccagagagttcccagggagcccctttgctccagcagaaggcaacagacaggctgggtggggagggagccgcatgatatgagggctggggaagagggatcctttttcaggtataacctaaatcctaccagttttctttccccactggcctggaaagaacaaacacctccagattcttaagcatccaagggtcaaatagggcactcggctgcaggtggaccctccccaagcagtggcccttgtctcactttgcttctaatgcccaccgacacagcctcccccaggaaaaggcaatctgctcaggactcctctgaggcaagcccctgctgtcagatgctgatcctcccccttacagcctctgaaacctgtcctgtaccctcgccatagcccagaggctgccattccccagctcacatgccctatgtggcttccttctgcttagagaatgcagggacagtggtcctaaaagcatagcctgtccttttgcctcttcgctggtccccaacatcttgtgagctccttgaaggtggcaccacatcagaaaataatggttgctggatgaatagctacctggataaaatattcaaggcctcacagccatgatacatgctaggcacttgtggcaaagcaacaccaaagctggggccacccttgggctctccctggccatgtgggaggctgcaggtggctaaggaagccaaagcataaaagccccagctcagagcctggtccataggtgtccactgcatgtgtggggaggctcaggaaggccaatcctggctggacacccgcgggagcagctgaggttcacccagagccttgcacagtactggacacagtgcgtaggtgctcaacacaggtttgttaatagtaaatgaagtctcacggctcacgtctgtaatcccaacactttgggaggctgagatgggcagatcacttgaggttaggagtttgagaccagcttggccaacatggcaaaaccccgtctctactaaaaatacaaaaaaaaaaaaaaaattagctgggcgtggtggcatgcacctgtagtcccagctactcaggaggctgaggcatgagaattgcttgaacccaggaggtggtggttgcagtgagcaaagatcatgccactgcactgcagcctgggtgacagaagagacaatctcaaaaaaaaaaaaaaagagtcaatgcagcttgtttgtcacatcttcacatccatccctgattaatcacaacactgggctggggaccatgtggcctgagtctgccctggcagtgagaggggacagagggaggtatgctgctaccttccagattcctgcaggcatccatgctgcctctcctcccatctacctgcccaccccctgtctgccctgactccatgtcggagggggcttcaaatatggcctggcaggctggttgcaatggctcacacctgtaatctcagtactttgggagggcaagatgggaggatcacttgaagccaggagttcaagatcagcctgggcaacatagtgagaccaccgcctctacaattttttttttttaagatgacttgggcaagcactgctgtgggccagaactttcacacacacatgccctttccccatcctcactcctatgctagaaggtcgttctctggagtccctgggccccgagtcactaagcgggtccccaaggtaggcttcagaatcaaaggggcagactatttgaaaccagggccacatcaccatcatatgaggttcttatccccattttagaaatgatgaaattgaaacccaaacagatgaagtcacttgtccggagttacatctgattagcagcaaggggttgctgaagcacaaagcttggtctctagggtaggggtcataactggtcatcaaaaatggggttggggctacagaggcaggccatggccactgcccagctctcccactcactaagaacccccactctgcctccaaccctgaagatgaatattccaaaggctgacactgtccatacctcggtactaaaggaaaagacagaaggcactcagggggttcgcactgcagtcccctttccttggctaagcaaactggggaaatgctggcctcaacagtaaccacagccctgagcacctgcacctagagtcattcaagactaggactcaggtctcccagctctgactcctttcatcctcacaatatcctgcttaggaggtggacaccattcttcactctattttctcacctcacagatgagatacagagtgtttaacaagtgtgtggaagcgttaactatgattcatcaagatgcttatgaaactgctcggagaagagcaattgccacttgttcctggagacaagtggaccctaaaaaaaaagctggacagcctctctccaagccacatagtcagagatgagatgaccagcccagaccctgacccagccagtgtgaactcttcccacttaaaggctggcctagtgcctcaatctcatacccctggtcgcttggttctggcggtcctactgcaagtaatatggccatggagtgagcactgagtggggaggtcaggaaacccaggctgcaggcatgactctgtcctcagcacatcagagagggatggactggggtgagggtttcttgacataaggtccccatgggcttcaggggatccaagaatcctctaaagcagaatgcaaagtctggtgtcaattaacggaagtgcatttttctggggatggctttcatcagtgtctccaagggctctgtaaatcaaaaaaagttatggatacccagaatgggtaatcttggaggctccttccatgccctagtattcctgggttatatatgggtttaaacgtgaagtacactccccatccttcaaggccaattcagtggctgctctgggaagctctaacagatttcttgcttctttgactgcagggaaaggctgggagcccaacaccacagagcctggcagggtccctctgccctgatctccctcaccagacagccagctcccaaaagggggcaggaccagcccaaggctaaggtagcagatgccagcaccccatacttgacctcttgtggctcaccgccccccccccacagtctctgtcccctgaagggggtctcagggctgcagagcacaggggcactggggcctggagtccacatctccctgctgcagccctggagctttgcagagccatgctccttccaggaacctggttttcattaaatcgggtaaaggagtcgataaccgccaagtccaggagaggcaaagttctgctagaaggcacagggaaggtgagggagaccagcctgtctcttgccctccctggctgaccgacggcagggggaggggaaggcagggctcctaagggtccagcaatggcagcagtcggagcttggggggagagtcgggggagtcctggcccagataataagcaattgttaatgtgatccatatggatcctgactggcctctctgtttaacagaatgataatggcagggaaagaatgctggtctgtggggaagggaaggggcaaagtcctccccggacttgggggggtggggtagggtcatggggaggagaaggaggcaaataagggaaagggagaggaggagccccacccaggggtctccaccacccaagagcacagagctgtttacctgaaggtggccagattccatgctatgcagactgcctggctaaaggcccttacaaaaccccttttattcagccaaccaatatttatggagcacccacaaggtgtcaagccctgtggcaagcccactgggggcagggccagggagtacatgctccatttcagtcaaagccctgagtggaccccgccacaaaggcggaagggagcacaggtgcaggccacggagggaggagcaagtgacagaagctcggggctggggaggtgatgcggaggaggtgcgcatccgagttgggccctgaagaataaggaggttgtggaaagacagggacaatgaggaaggcatttggctggaggaacagcgggagcaaaggcagagaggcgtgaaattgcgtggagagagccctagatctcagcaataaagctgcggcccaggcagggcagggaggggagtcctgatccataaaaagctgtggccatgggtgagcagaagaaaggcaggaaagggctctgcgacgccacactcagtctgggtggctctccccagccttcgcccaggctggtactggaattgacagttacgggatcctcagcccagccctcagccataccacggccagagaatcgggcagggcctccgaagccaaactcatttctgtgtctctcagccccttctgtttcttcttctggggcgggggtgggggcaacaggaatccccccgaggaatgcgggtcctctaggcctccccaggagcaactcctctgccccacacagcctaattccctttggcccaaaagggcttcgcccagaagatattacagcgaggacacgagggtcgctcccgtctgccttggatgccaatggaatcaagtggaaagaaatgaaatggtgttaaacatgggaaaggggatttacgaggcctgtcacccgtccagcccagccaccccagcaagccccgcccctttcctcgcccaccccaggaagtcccgccccgccccctgcccgcagctcgcgcggccgcccggtacccgcgtcccacagctgggtggcggcggcaccacagcaccgggcagcccggcgcgcccgtccttgggggctcaggcacagcggggaatggcgtcggttccggactgagaggctcggggaggctttaggaggatgctatgggatttcggggtaggctccgggagggtctgggactccctctgcagggtcagagggtttcgcaccgtggcatctgcgggcccagcccactccagagactgggcggctccacaggggaggccccacggcccaggaaccgggaagcccacctgcgccgtaagcccagagttgggctggaaccgggtccccactcctcgctgccgggcggaaagcaggagaccgctccgccgccacagcccgtgcggacaacacaaacattcttcagtcctctattctcctccaaattaggtatccatggagacagggccggcagcctgacagccctacggcctaatcctgatttagtgaccgtccctttaacagcccacccacccgtccacccacccctgcgctccgggccgccgctgggcgcagggtccaggccgcgcgctctctgccccgcgcagaccccttcccaggcctcctcctctggcgggggcagggggaccagcggggctggggaagggcaccagcatttgctgatcacctacagggtgctcagcaatctgcgaaggaccctctgcagcggcgggggggttgctagcatgcgaatctctgtgtagaacaggagagggctcttgcggtggggaagtttgaggggccctctctggagagctgggcgctccgggggtcccccttgttgcctgtagccccagggtgaaggtgagtacagcctcctacaaccccctgactctgagacgcgggctctgttctcccgggccagaggagaagacatgaagagggtgggtgttaggggcgcggggaccctaagtagcctcggcctcctgtcactgccccgtcaccatgctggggaatctccgggccagtaacccagcccccacccctcccacacacacacacaggggccgctggacaaagacctgacggagtgggaggggcctgcgggccggccctcgggctccggacgctggatccttctgggacccgaacccgcaaaccttggctccccacccccaggccagcagacgcccccgagccggctgctcgctttcgctgcagcccccgcaccagagggggctgcgagacgggtgcccgtcggcggccgggcggctatcccctgctctgcccgccccctccccccgagaagtgaccctcggctcccacgtacccgctagggtctctcgccggccctgccctccgacccccgccgagctgaaccccgcgactagcagcccccgccctctcggccctctccggccccgggccggcggacaaagctccggacaccctgaccgaacggtcacctccccccgccccatcccggcccgcccgcggccccgtacctcggcatcacggccgggtcctaggtgagtgtgcgcggcctgggggcgcgtccggcccggggaccggggcggcggcgcgggccgggggcgacaggcctgggctggggggcagtggcgctcaccatcctggagccgctgctgctgcggctgctgcggccgccgcgggcgggagcgggactgggcagtgggggtggccggacaaggggcggccccggctccccccgcaggaaagacccccacccccacccccgcctcccctcgcccgcccccagggccctccctcgcaggccctccctcccctcccctttccctgctcctccctctcctagtgcccctctcttcccccagctcccgccccttctctggcccctccacccccggcttcttccccgccctcccccacctcgcccccgccccgcccccacctcccctgggctcgcccagcccctccttgccaccctcccggctggccccgccccctcccgcccctggctctaaaataaattagccacagaggggaaaaaagagcaagtgaccctcggtgtggagagtgtccttcgccactctcagacccgtccgccccgcctctcccggccgtcggagcgggaagctggggttggggtgggggtcgggccggcgggtaggggtgggggacggcatggggacggggccgaggccgggactgagcagcccagcccgtcgagcgtgtccgctggatgtgggcggcttcctgggtcgaagggcaaaggggaaggcagccggcctgggcccgccccgtccgcgggccgccccagaccccctttcccaggactgccttggccccctggccccagtctggaggactcttgctcacttcctccgcccccaggtgagctgagaacccactgcgcgcgggactctgctgcgcctgccctcccgggctgcagagggcaggacgcaccgccaggcaaggccgcggctctgcgctgatgccactccgggagcgggtggctgcgggggaggagggcgagcactggacgggggcagcggagtgtagggtgtgagatctaaacagagggctccactggagggcttgcccagaaggcggcagtcacactgggccaagcaggatgactggcaggaagaaaagatgagggatgaatcccagacctctagtccactgagagtgtccaaagacatccgttcaatagatacatactgagtgttaactttgtgccaaacattggactgtgcaccagggatacccaagagagtccaagaggcacagccctgtcttcctggagctcccagtcgaagggtagacagaattctgcccgacacacacacactcaaggcttcatcagggataaaggccaggaaccggctttgccccaggagaaggtaggaggagggctgtgctgatgatggagggtccagagaaccttcctgctgttgagcctccagatgtcccaaggcaatcctgtttccacccaagggcagtgcttaagggtcctctctcctgagagcttgtttcccttttgagtggctgcctagcctgagtgtcagtagggcaagattggccctcacccactagcctgtagaactccaaacactaccccctcccttcttctaatgcagattcccctgcaggctctggggtctgacaggtctggggcactcctttaggtgccactcagggaaacagaaggggagggcctcagtagctcccacttcttttccagcccacatttggaagcaaccggcacccacgcaggttctggaacttgccaaggtcagtgtcttttccacctccagaattatctcttccttgccactccccacccccagggctctgccctggcacaggaggagggacgtgtcaaggctcagagtgctagagtagcccctggcttcagaatcaggcaggatgaagggagccacaaccaccatgctaggagactggaacccttgctggaggaacaatcccaggataccagctggaaggaactccttggctatttccttattgttggagcactggaggcccagagaggagaagtgacacacttggggtcacacagcaaagctggatctagaatccactgcactttttccacccctacctgtcaggttccctgacagccagagacaggaactaagggaaagactaatatccttatgagctgggtgcctcagccagcaggattagtgccaggaagccaagtctggcattgccaatggggatcctgctccaccatgctccagggaaggggggatgacaggagtggggttggactgaggcgctcagtgtgaaggaaggaattgatcatgcgctcccctggagcggggatccggttctccttcatcctctaggagtccgggagtaaaggaaggacaagcttaaagctaaggaaggccttgctagtgagatagtggaagacaccagcctgctggataaggccttcgctggactccaggggcaagaccagcagcttggcagtactgagttgtttccaatgggcggactgctgtgggtgatattaagaggtttagttagcaggtgggggtgaggttgatcatttcacccctccacctcccaccctgcaccagtgctcagggcgatgaagtgtggctccccctcccagagctcattaaagtcctgttaatacatcatccagcctcctgggctgacaaatactctgttcatcacatctctacctcctgccctcttgggcagggcccgagagactgatctctgaggactctggggtgacctcactcctggctgtccccagtcaagggatctgtgccctgagagcccctgctgaggtggctgtgatcatccccaggcaggtcaagtgcctggcaatggattggataataatagtggtaatgatggtggtaatgtgtggcttctgcagagggccctccattctttcccagatcttttgctagtatcacacccaaggtggagaatcccacccccatcctgcccccaggggagacaggtgctatgcttggttgtgtggctgagtgcaggcacctgctgcgggcgcatgcatgtgggtgtgcagcagaagtgtgggagtgtgtgaccttcctggtccagagacctgcaacaagggctttctaaaaacattaagaagaaaaataactccgtgggtctagggagaatcagctcaaaggattttggagggaggggggagagttagagggaggaagtaaaagctagagagagagggcgggaggagcaagtagggtgaggaggaaggaaagaaaagggccccgggttgggggaaggatggggtggggggaggaagggagaaagaaatggaagagaggaagaggaaagggcggggaggcctctttgtggtcctctggactggccactcaggagtcattatgagcaggaaaggaaggaaatgtgtcctggcttggggattggggtgcgtgcccagagggcaccacacccagctgggcttccccccaaccacacttgcccgggactcaggctgctgtccccacaaatggaaactctagcccttctcattcttgctctttgcccatcaaggcccagttcccagtgcctccccaaccctgatcaaaccaccccaaaaactcttactcttcatgaacgtataccagctttgccttcccactgtgctacaagctgtgtctagtctggatcctatccccaccccacatccagcctaggagccctcgaaagcctgtaggcaaactagaaaacatgttcctccctctatgcagctcagacttgggaggaggagctgggtggctatcagtctccgctaactccttggggcccaacacttggggacgctgatacctcgcttccaaaatcgttaccccacacatggccctgctgtttgttctttgagcagaagcacatcctgcaccatcctgcagcatagctcttcagccagcaccccaaattgatcccaccatgtaccttacagtcacacagaaactcccactaaacatgcatacctttttaatacctcagaatctttctgcctggaatctcatttccctactctgcctgatgagctcctattcatccttcagaacccaactcaggtatgcccttctctgtaaagtcttccctatctgtcccgcatcctagcagagcacttccaatcttttttttcccctaggttccaggggttgagcccactccatcctgtccaaaggcagaagcctcctccaagtcctgcacgatccgccctctaacatgcaagcccatctggaacctctggaatcctactgggcttcttcgctccctaaagtttacagacccagggcaaaatagggaactgcaaatccaagtggcccagaggtctctccacccccactctgccctctctgggcctgagcctgacaggagattcccagcacatctggttgtacttaaatcatccagcactactggagtaggttccctgcttctctcccttcagccccagcctcctccccttcctacaccagccttccaggtctctcctccaggatgccttccctaactcatccagcctcggtatctgcaccccacccttgaacctccacctctttgggtctggagtctgccagggtgtggaagggagggtgtgtgctccgcaagactcagtgtgtagaatctcatccttcccgagcattggtcctagatagaaaccttcccttcaggtaaggaagggagccagccaagagcctcccctctgctcccttggcctcaggggtggctgtctccagttatgggtgtgtacagtggggaggaacaagttcagatccaggcagagccattcctttggcaactcttgctgtcagccatcttccaaagagctttgcaaaatgttaaagaacaaaagagaaataaatacagagaatatagcaagtataaaaatgcacagtctaggccaggcacggtggctcacacctgtaatcctagcactttgggaggctgaggcagatggatcacttgaggtcaggaatttgaaaccagcctggccaagatggtgaaaccccatctctactaaaaatacaaaaattagccaggtgtggtggcgggcacctgtagtcccagctatttgggaggctgaggcagaagaattacttgaaccccggaagtggaggttgtagtgagccaagatcacaccactgcaccccagcctggctgacaaagcaagattctgtctcaaaaaaaaaaaaaaaaaaaaaaaagaatgcacggactctaaagaacaagtttgtaacctaccatgacctgctccaccagggctccaggtttgaatgttcattcattcttttattcaatagcatgtactgatgcctgagtctactaagttctaggaacagtgactcaagtaagatcccagggtcagtgggggacaggaacaggtggatgaacaaatgctgcatgctgtaatggacatgagtcagggagacagaggggtgccaaggttgaaggtcagagaccctggactgaatcccacctctgtcactttctgcactgtctctggggagccacttaatcttggggagcctgtctccccacctggaaaaggacgatgatgtgacctcacagggtcgtagtgggactcaaataagataatgtgtgtgaaaacgccttgcaaagtgctaagtgagttgttgctattatgattaggctcaggggctgcctatctgacactcatttttctaatgcctcaacagctgtctctcttaccctcccagggcaggtaccacgttggagaaacttctgagggtgaaggacacccaccctagagtagtgggcagttaagctgcccgcatagacacacacacacacactttagttacacaagcagaacacctttttataaaaattcgaaaggcatcatgtgcctacagcctcagttactcaggaggccgaggcaagaggattgcatgagtcctgggcaacagagtgaaacccatttctactatttaaaaaacactaataagaaaaaatagataagcagaaaacaaaaaaattaaaaatccaacgcctttaatcccaccacccagagataaccaccagtaatatgttggagtcagttagccggtcacagtggtggggggcctgtggtcccagctactcgggagactaaggtgggaggattgcttgagccagggagattgaggctgcagtgagccgtgattgcgccaatgcactccaccctgggcaacaaagcaagaccccatttcaaaacaaaacaaacaaaaaaccattttggagtcagctagatattattctatttatctctctctacacacacacacacacacacacacacacacacacacacacacacacacatatgtatatatagagagatctccacagtgttttataatatacttttcttaatagacaatttttttttttgagagggagtcttgctctgttgcccaggctggagtgcagtggtgtgatcgcggctcactgcaacctccacctcccaggttcaagcaattctcctgcctcagcctcctaagtagctgggattacaggcatgtgccaccacagctggctgattttggcatttttagtagagacgggtttcaccatgttgaccagtctggtctcaaactcctgacctcaagtgatccacctgccttggcctcccaaagtgctgggattacaggcgtgagccaccgcacccagacaatggacaaatattttgaacatcttttgctgtctataatacgtttataccacacaattgttaatgacagcttaatattccatcaagtggacatgtctaaattaatttaaaaagtttcctggccaggtgcggtggctcttgcctgtaatcccagcactttgggaggccaaggcgggcggatcatgaggtcaggagtttgagaccagcctggccaacatgatgaaaccccatctctactcaaaatacaaaagttaggtgggcatggtggcgcactcctgtagtcccagctactaggcaggctgaggcaggagaatagcttgaacctgggaggcagaggtagcagtgagccaagatctcacctctgcattcaagcctgggcaacagagtaagactcttctggaaaaaaaaaaaaaagtttcctttgttgttgatttttttccagaaataaaagcttcatgaacaaacctgtaacttccacctttgtgcacgcgtctaattattgccttaggataaagttctggtaaccagaggctaggaatgcatatttttatctctgaggagccaggagcccaggcctctgggcagtgctctcacctctcctccaggcagccctcccagacctccagggttgagtacatctcccatggtcctttcctctccaagtaacttcatctcttagagacctgccctgagacccctgaaaaatgctgggaaagtctggctggtgacggccaggaggggccggggtggagagcacaaagcaggcttgtctggggcacgggaagaggccccgccctccgtgctgctggtccaacattcctcctggacaatggctgccttgggaatcccgggaatgaaggaggcgggcggcttcccgaacctgcgccctccacccccatcaagttgcgccctttccccagatggaaagcaggggcactttgcattgcggcagggtggggaggccagctagcctccatgcctacagcccccgcccctccttttaccaacactaatccacaacgccccgcagccgagtcctgctcagccaccccatccccatggaccttgggcgagtcctgctccttcaactgtaaaatcaggagcttggattcagtggttgcaaaactccccacagatctcaaaggccgaaatgtagtgactaaggcatgcacaggctttggagccaggttgcccgagttcaaatcctgggctgccctttaccctgggaacttaagcccctgggttgccggcttccctctcgcaaagtgtgtttgttgatacagctccactccctcccgatgggaaggcaaactcctcaaagtctataaatcccgatccatgtgtaactctgctcaaaacactaaccagatctccaaccccaggccccctcataccctgtgcggattttggcccctggacatttgcccaacaactggccacacttctgggagctgcgacgggcacctgatatccctgacgaagcatccttccccagcatgtttccatcttcccttgcatcagtcataaggccgtaaagctgtaaatggtaaaggcttactggggcacacaaaaattttaaatataggaaaactcttatttatttatttatttagagacagagtctcaccctgtcgcccaggctggagtgcagtggtgtgatcttggctctctacaacctccacctcccgggttcaagtgattctcctgcctcagcctcctgagtagctgggattacaggcatgcgccaccacgctcaactaatttttgtaggttttgtttgtttgttcgtttgagtagagatgaattttcgccacattggccaggctgctctcgaactgctgacctcaagtgatctgcccgccttggcctcccaaagtgctgggatgatgggcatgaaccactgcaccagccagaaaactcttatgttaggtcatatgtccttatttttgtttgggaaatgcaggcatttccaatgccaccagcaattgctaggcatcatgggtggtatacaccccaggctcttattaacctattggagggttagaacaaacacacttcaacagggacccattcacaaagttacctctggaaatattcctgagctttttgccacaaatccctgcccactctccctcatagacttgttccctgcttccccttactcacctcctcctcagccctattcctatgctcccctgaattcagatcctctgctgcaagtgccagaaaactcccctcataatggcttctactataaggaaaatacatgatcgtatttcatccaatttagacaccaatgatgttaagaagcactgctgcttcatgtacttgattgattgattgattgattgattgattgattgatttttcagagacagggtcttgctgtgttgctcaggctggtcttgaactcctgggctgaagccatccttccacctcggcctcccaaagtgctgggattacaggcatgaaccaccatacttcatgtactttagaaagaaaaaacactggccgggcgcggtggctcacgcctgtaatcccagcactttgggaggctgaggcgggtggatcacaagatcaggagttcaagaccagactggccaacatggtgaaaccctgtgtctactaaaaatacaacaattagctgggcgtggtggcaggtgcctgtaatcccagctattcaggaggctgaggcaggagaattgcttgaagccgggaggcagaggttgcagtgagccgagatcctgccactgcactccagcctgggtaacagagcaagactccatctgaaaaaaaaaaaaaaaaaaaaaaagaaagaaagaaaaaacactaaaactgcggattaaagtgatgatgacttcttatcacttagaatttttattttacacttactgaaaaggttctcttagacttactacctttgtacttacgtaacaaggaaaacatgggtgaaataaactggttaaggttttcctaaaacttcaccccattcagagtctgattcttggatcacttttcaattcccagctgtcaatatctgtttttccacacagaatcagcatctgggccatcttacaagtactggtgatacagaacatttcttaaaagtgctctaccaggctgggcgtggtggctcacacctgtaatcccagcactttgggaggccaaggtgggcagattacttgaggtcaggagttcaagaccaacctggccaacatggtgaaaccccgtctctattaaaaatacaaaaaaattagcctggcatggtggcacacacctgtaatcccagttacttgggaggctgaggcacaagagttgcttgaacccaggaagcggaggttgcagtgagctgagattgcaccactgcactccagcctgagtgacagagtgagaccccgtctcaaaaaaaaaaaaaaaaagtgggccgggcgcagtggctcaagcctataatcccagcactttgggatgccgaggtgggcagatcatctgaggtcaggagttcgagaccagcctggccaacatggtgaaaccccgtctctactaaaagtacaaaaattagccaggcgtggtggtgggcgcctgtagtcccagctactcaggaggctgaggcaggagaatccctggaacccaggaggtagagattctagcgagccgagatcgtgccgctgcactgtagcctgggcgacagagcgagactgtccccccccaccaaaaaaagtgctctaccaaattatctattgctgcataaaagattaccccaaatcggctgggcatggtggctcatgcctgtaatcccagcactttgggaggccaaggcgggcagatcacctgaggttgggagttcgagaccaccctgaccaacatggagaaaccccgtctctactaaaaatacaaaattagccgggtgtggtggcacatgcctgttatcccagctgctcaggaggctgaggcaggagaattgcttgaacccaggaggcggagtttgcggtgagccgagatcacgccatttcactccagattaccccaaatcttagcagctttaagcaatcaacattttatattatactttctgtgggtcaggactctgggtatggcttaactgggtggttctggctcctggtctcttatgaggctgcactcaagctgtcctctgggggctgcaggcatgtgggactggagagcccactttcaagttcactcacatggctgtgcacagaccttggttcctagctggctactggctagagaccacctcagggcctcaacacatgggcctccctataggcctcctaactgtctttatgacatggccctggcttcccacccccacagcaaatgatccaagagaaagcacaagtaagcattcaagacagaagagacagtttttttgtttttgtttttgtttttgagatggagtcttgctctgtcgcccaacctagagtacaatagctcaatctcagctcactgcaacctccgcctcccaggttcaagcgattctcccacctcagccaaccgagtagctgggattacaggcacccgccatcatgcccgtctaatccatctaaattttgtatttttggagagatggggtttcaccctgttggccaggctggtcttgaactcctgacctcaggtgatctgcctgcctcagcctcccaaagtgctgggattacaggcatgccccaccatgcctgactaattttgtatttttagtagagatggggtttcatcacgttggctgggctggtcttgaattcctgacctcaggtgatccactcgcctcagcctcccaaagtgctgagattacaggtgtgagccaccgtgcccggcagccatagtctttttataacctaatagcagaagcgacatcacagaatttatttaattatttttttcagacagggtcttactctgttgcccaggctgaagtgcagtggcacaatctcggcttactgcaggctcgacctcctgggctctgtgattctccttcctcagcttcctgagtagctgggactacaggtgtgtgccaccatgcctggctaatttttttagttttctgtagagacgaggtctccctatgttgcccaggctggtctcaaattccatttaagaatggacacatggcatgatttggcctatgagacataaggggatgttttgtgggaagcttctaaaaagatttcacagaggctgaaagagaaacagtttttcttggcctctgaatgtcattgtctgcctgtggtgtctgaaactgcagcatctaccttgtgactttgagggaagtcaggatacaaggacaaaaatccagaggataaggatggcagaaaaaagagaaagaaatgtggtggaatattttgagtggaaacctattcagcaataacaatgagccaggcatgagctcgtgcctgtaatctaatgctttgagaggctgaggcaggtggattgcttgagcctaagagtttgagactagcctgggcaacatagcgagaccctgtatctaaaaaaaaaaaaaaaaaaaaaaaaccagggccgggtgcggtggctcacgcctgtaatcccagcgctttgggaagccgaggcaggcagatcacaaggtcaggagatcgagaccatcctggctaacatggtgaaacaccatctctaccaaaaatacaaaaaaattagccgggcttggtggcaggcgcctgtagtcccagctactcgagaggctgaggcaggagaatggcgtgaacccaggaggcggagcttgcagtgagccgagatcgctccactgcactccagactgggtgacagagcgagactccatctcaaaaaaaaaaaacaaaaaactactgatacaataaaatgcgtgaatctcaataccattgtctgaagccaaagggccagacacagaagagtacatacaatataattccattcataggaagacctggaatatgcaaaactgatctagaggtaaacatcagattacctgtagcaggaggtggccggggatggggggactgactgcctatggacaggaggggacttgctgcatgatgtcaatattccacatcttgattggaatggtggtgaccaggtaaacacttgtcaaaattcatcaaactgtagttttaaaatctgtgcatcctggccaggtacagtggctcatgccccataatcccagcactttgggatgccgaggcaggcagatctcttgagtccaggagttcgagaccaacctggacaacatggtgacaccccatctctacaaaaaccacaaaaattagctagacatgatggtgcatgcctgtagtcccagctactcaggaggctgaggtggcaggatcacctcagcccgaggaggtcaattctgcagtaagctgtgattgtgctactgcactccagcctaggtgacagagggagacactgtcttaataaacaaataaacaataaaataaaatctgtgcatcctactgcatataaattgtatttcaataaagttgacgaaagaaggaaagaaaaagaaaaccaaacaaacaagaaacaaagaagtacagaagtaacctaggtccttgataacactgttgagccactgacttcaccaacagccttgggacttcttgttttgtgacattataaatgctgtataagccatttttaagttgggtctctcatagctggaagcccaaaacacctttatgtcaagggggaggagaggcatccagaaccagcctggggaagtgggttttgaagagcagctgagaaggcaagagactctgaagcgcgcttgatccggtggggtctgcttgctgctccaccatcaggcccagtatagctggggatttcttcccacagttccccaaccttccccagcccatctgtgaaatggagaccctggtaatcaaaggacctagtcttaggcttctggagagggctgatgcagagacaatgcctgaaagctcttagcacagagcctggcgcagacggaggttcaatgtggtgtacctcccctggccctggcaaggatgacctgagcctgaaccaagcaggggcaggcagagaggagggaacagaacttagaaacctttgggactgtaaatgatcgataacgccaagcactcgggcatgggtgacaatgtggatgggatcatttctcaggcttttggcaaagattacatgcaggatctgttttcatcaccaggtaggtgccggtaaaaggagagaagagatacagtaggagaaacaggtttggggggtgaaaaagtgtaagtttgaggtatctgtgagcagtacggcgtggtggacaagagcaagcgttctgccacccactagctatgtgatctgggtcaaactaccacctttctcggagcctcagtatcctcatctgtaaaatgggaattctaaaaatacttagctcattgggttgctataaagattacatgaggtcgggcacagtggctcatgcctaaaatcccagcactttgggaggctgaggctggtggatcacaagttcaggaatttgggagcagcctgacaaacatggtgaaaccctgtctctactaaaagtacaaaaattagctgggcgtggttgtgcacatttttaatcccagctactcaggaggctaaggaaggagaatcacttgaacccgggaggcagaggttgcagtgagctgagatcagccactgcactccagcctgggcgacagagcgagactccgtctcaaaacaaaacaaaacaaaacaaaacaaaactttagatgaaacataacaaaaagaaaaaaacaagattagatgaaacaatatattggcagtgcttagcatagtgcctggcacatagcaggtactccttaaacggtgataataaggtcatcatcccttcatcccttcacagcctgcgtcttcgggttaggcctaggagggcagcctcctgctgagcctctgcactagaataccaaactcagcgtgaggctctttgggctttcagcttactctctcttgcctcaaacaggatgatcccctgtggaagatttcttctcctttcctttttccttgaccccttccctccctcccttccagtctctactctgccctgcctctaacaggaagccttccttgactaatgtctctccattctctgccaacctccccactgcctccgtgtaggttctggccttccagcccagagctctatccaccctactccattgcccatgcccccagtacaaaccgtgggctttctccgtgccagctcaagggaggtctgaccccatggggacgcctgactgcaaagggaaggatgccgccttccaccgcagcaccaccacagctccgtggacccgctgggaaaggggtggggctggcgaggaggaggccacctgccagagtggcagcagacaggccagctaaatccttgacctatgatttaagaggtcgggcatagttcaatagagccctccaggctgagtcccagctcattcacacaggtcagagggatgaggggcaaggcggagaggagggccgtctcctccgagggcccttggcttcctccctagccttctggggcataatccagcctgaaaaccacaaaaaccctgaaaaccaccagctccattcccatcagcgtagatgccccctctgagaggccgggggaggagggcggggccgggagggggtgggcagcagggcaggaaagtggagatttaggcaggcacagcgcctggcacacagcaagggcgggaaaggctcctccctctgctaaccgcggcgccctttgttaggtcccgagacgcagcggagctgcctggcttccaggtcggccctggtctctgctcccctccgttgcctttggaatttgccctcagacctggaccctaccagggaacagcgggattgtctgatggaattccacgtgcaaaccgagagaggttttgccataaattctagtccggccccgggaggagggccacgcctgggccccactccccatcaccctcccgcctcccagacccccggcacagggcctccccaggccgtgccccgggctgcccctgggagcgctatgcaaatgagatgcaaagtaggccgaggcagccgcaaagattggctgccgcagaggctcagtccgcccaatccccggccgcccgccatcctgggcgcccccggcccggggcccggtcccgcccgtaaatcagctccgtcagcgttaatggctcctgactaattgcctggacttgggctccgggctcgggtcgccagcattaaaattcaatcaggcctagcgctatgctattaaatattcattgggagagcttcccgaaatcgggctgggggatggggacggactgggttggagggactacccgaatcctcagctccagaggaggtgccgctcctccccagcgtgctgtcagcttctgcagcggctgccgggcttccattcggctgggtctgatttctctctggaggtccctgcgccctctctagagacttttgggagactgagctgccctgcagaaggaatgttaagttatgccaagggggctgtgtctgctcaacgcctggtcacctcgccgcacgaccctttacccagtgcccaccatgagctcctattcatgctggaaccttaggtcccaccgggagtggaagagctccagggcacagaaggcttaatctttagaagagcccctacttccctggccctactgccgggtttttatggagctacactggccatcctcagcgtggctagagagagcatcagtctgggcagctccgggtgtgtgctggaagggagtagtgggctttgtacagtcctcccctcctcttccctgccctcaggaatgcagcctgtccgagctcctgggcccctggcctgatgctgagcaggctgcctggaagttctcaaagagggtaccaagggggagggggctgggcctgagggggcccttgggagtgtcagggacttaagcagaaactgcatcctccacccacacacacacacaatagtcagagggttatgaagagggcttagcagatgtgatgacagccatggctcaaggactgggtgagccactcaaataaagaccaagagtttttctaggccctctatgatgtattgacacatctcttcacgcggcagctctagtcctcagacaaggaggtatttgggtcgggaggaagagaaagtcttgggaagtgtgctaggagagactcatttccctcctctggattttcaaggactcctcaggagcaaaccacctgttcacagggcttgtcccctgccctttggactgctccttgctcctagtgcctgaggatggtgcaaggaattaaccctgtggggcatggggggaggctccgactgccagagccacagagcacccgcagacgctgcaggggaggggtggaggctgagggtaccggtctctgcaaggccagaagccatcaggactccaagagggttgtaaattcagggaatactgttttgatggacactggaaggaacttcttggtcggcaatctctgagagcatcaacccttggccgtgcaggaagcctggaattcctgcctgaggacccctactcccccagggtgtagatgatgatcttacagcaagtggggtccaaggagcaccctctctccagaaaccaggcaggccccagggcagaatgcgtctggcagcgattaggaggagagctggggctgggaggcctcagacttcagcaggtcaggagcgaccccagccaagtgtccgattccaaagccaaacgtcacaggcaatccgggattccaaactcaccccacgtgtggttcccattagggctggctggggtcttcctgaaggccaggccagattcctgagcccctcccccaggacaacccctccctctgcaggcagtttggaatgtcttactagccccatggggtggcctgccagcacccacccttgggaatttccaggggtatccaactctaaataggcctctccacccactagatgatgatgttttgcaatccctcagaggggacaaagggataggagactttaaacctttaacttcccagggtgggccaatccctgaagatccctacagtgtgcctggggagtcttccccatctcccggtcagccacttttgttcaggcctcagcccctctggcctggacaactgcaactgcccccattcaccttctgctaccagtccattcctccacactgcccctgagcgagtgtcctaaaactcaggcctgttattcggattgtttccctccttgcacaacttccaatagctttccagcaactctgaagccattgaagactggtggccagtgggccaaatctagtcccattatgtttgtgtcctgtgtagttagggcactcacataattaaacttttttaaaaatagttgtcaagatttaaaagccaggaggcaacaccaaaatctacatttattaaaaaaaatttttttttggctgggcatagtgactcacgcctgtaatcagagcactttggaaggcgaggtgggcagatcacttgagcccaggaattagagaccagcctgagcaacacggcgaaaccgcgtctttacaaaaaaaaaaaaaaaaaaaggaaacaacaacaaaaaaacatagccaggtgtggtggtgtgtgcttgtagtcccagctactcaggagactaaggtgggaggattgcttgagcccagcaggcagaggctgcagtaagctgagtggcgtggtgccattgtactccaacctgggtgacagagtgcaaccctgtttaaaaaaaaaaaaaaaaaatttaaggcggagtcttgctttgtccctcaggctggagtgcagtggtgcaatcatagctcactgcagccttaattcctgggcccaagtgatcctcccgcttcagcctcctgagtagctgagattacaggctccagtcactatttttaaatagtgcacatcgctctatttttaaattttcttgaaaacactggcaatatgtttgcattcttggatggcaacaagtggctggggctgagtaacaactgtggcctttacaaggtatccctggggcttacctatgcaccattgagggaattctggaaacctcaccaatccctattgtctcccaggtctgaggcccagatgagtgaatggcctttttatcacttaggctggcccttgccttcttattttacttcttgtcagcttcatgtgtttggccatttttgttcctgtctaccccttcctgcagatacttcaatttgttataacaaactcaagtcaaaattccttgacctggtatttgtgtcccttcagactcccttcacacatggttcccctccatatcccagtcaactcctcccctccaacactcttcctgcaggtacatcacacttgccatgcttccccaggctgcagctggactttcacactcccatctttgcacacactgctccttcttcctggagcaccacttctcttccttctctggtgaacttttaaacttttttagagatggagtctcagtctgtcacccaggctggagtgcagtggcacaatcatagctcactgcagcttccaactcctgggctcaagcaatctttctgcctcagcctccagagtaggtaggactacagacacgtaccaccacagctggctaatattttaatttttttttttcagagatggtatctcactgtgttgcctgggctggtccagaacttcaggcctcaaataatcctccctggggccgagcctccggccctggtgaacttttattttattcctccctccaaccccagcccagaagccactgactctggggcatcctcctgacccctgcagaagtcagttaccctcaggttgtccaatggtccctgtgattccagaattctcacaatgtatcccctccctatagtgacagcccctccagggttttgaggaggcctgctctcggcaccccaaggctcactgtgctgaggagtcaggccatcggactggtggcagtgacggttaggggaaggaggcgtagttcagtcctgcaggagctggcctctgagacaaacacaggtttgtcggagtcagcaaggctacaagagagggaggcagcgggcaccttctgtgccacaaggtgaggttttctgggtcctgggcagcacggctgtctgtgtcaccagcggaccggggtgagtggcttcctgtaccagggcagtcaggtgctctctgctaccctgtgagtattctagtgagcagaaatccagaagaaaaaaagaggagcaaaacatcagaactcagggtgctaggcaaaagtgttcttatgagaaaaatgcgacagattatttgagactctgatagcctgggggtgatccataaacattcccgaactcctccaatgccccccagcactgtcatcagacatcttcaccctctgaagcccatgctgctggagaccccaggaaatggccttgataccaacctcccatccccagcccacactccctcttcctggcctaaccattctcccacccgcaggtgttgcttcccagactgtggaatcaaatcctctggatgcacccaagaagcaggtactgggtccccatttaacagatgaggacacggctctgagcgctgcccgaggttccccagccgacgataactccagcccgccgggcccgaagagcagagtcctgcctcctccccaccggcttcagcctcgggcctcggctctgctcctccctcctacacacaccccggacgcgtctgtccaggtccgaaatccagatccacacgtccgtatcccgaggcgggcgtgaactatccacccgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccagagttgtttcaggccagggccggccgcaaccagctccgggcctttaggtcctcaaagttccgaagattttcaggtcgagccagtggcccaggctagggagaggggagctgtacggttgtgcaggttgtgacctatacaaggtgggaggcgtggttgtgggtgagtgggattccaagctcggccttggcaggtgctgactcgttctgaaggagggcagggggcaccgtttctcacaaaggtctcggatgagccagcctggcctgcccttgatttagggctgctgagggtagacacagtgggagagcaaatggctagggttggcccctgtgggtcagggccagggctaaagaggacagggggactctcctggcccagagtagaaacaactggatcatctgggctccctgggcctttctttcttcttgaattcctctcccaccctcaccctgaatcttgttcctctgtctctaacatagttcctaaaacagcccctgcccctgcccccactcaactgcccaagctcctgttacttccctgcacaatcgaaaagactcctgtccgctctcccagggtccccaacaatcagttcacactgcaggcaaagagacctttaaaaatacaaatcaggaaaacaccagggcatgtgattcctcgcttaacagccacccacagcttccctgcaaaggaagcccaaaccttttcccccagcccctacctacacagacagacctctcttcctatccttctccccactgcccagacactgcttacactggctgcctttctgttcattgaacttgataagctttcccccacctctggccttggctttgctggtgcttttcctggatcgctctgcccagatccttcccaggaacgtcaccttcccatcatccctgaccacaataataaagcagccccatctgcctgatccagtctgtcacttaaccttatatatttcttccactgaactcaccacattctgtaattatctttcttattcacttggtttgtggtctgtttcacttaccagaatgtcagcttcatgaacgcggggaccttgtctttcttgttctctagcacaatgcctggtgcaaaccaagaagcactcagtacatgctccatacattccaggaaaggagtccctgggaccaaactggatgctagttcatctggtcacctccgagagggcttctctctgggtggggccagctacaaacacctgtactcacctggtacccacctagatgctttgcacacatgggcagacccatggcttactataacaataatcttggctgacagctaatcagctgactgtgccagacatcattctaagtcctttacatagtttagtttaatttaactcattccatcctcctgtgaagtagacactaatagcctcagtttacaagtagatataccacacacacagatccacaccacaacacacaggcagcataagcattgaattcattattactatccaacagatagatgagtggggtaaagaaatcagggtgagcctgggacatttaataactactgtgggaagatgggaagaacaccagggaaagctcagcatgggggtcaggcacagggccagctgggcaagtggtagaagaggaagttgagcctcagcccacgcccatattctgagtccccacagcacttggagtggtgcggagggtggttcctggttcagttctgctacccaccagaggggtgatcttgcccaccagagggcaaccgtttaccctcttgagaccacattagcaaaatggtgggggaggcgtacataatacctgtctcccagggaccccaccaggatcaaactccaaaatgctcatgaaagccgtgtagggcttgctgatgaaagggtgcaggttgccagccgggaaaactggggctggagctatgctttggctcttctggaaccatagctcactgctgtatgaccctccagagtggggggctggtggaggggctgggtctcaccaaccattgccccctctgtacctggcctggtgctcatctagaactccataggtatttgtggagtgaatgcctgcgtgagggaaggaccagggcataggtaagaggaggagaatgaatacatgagtgagaggcagagtgaatgaagcagggactggagacgccctctgcctctgagcctcagtttcttcatctgtgaaagccagtggtggggcttggcccacttctgtctctgggctccagtgtgaatcagacaagatggggccactccatggaagcccctccttgctatctatgcagggcccccagggtggacggggggagctgaagtgaccagtgttcccctccccccatccctgtcccccggaatttatagattcctcattgtcctgcacaaaggccttcttgaggagggggcggggtgatggaggagacgggagaattagaaaggcggaagctgagcaacagccagccacacccaaggccccataaatctgcccaggcccctgtaagatggactcgctttgccgcacttgaagcggcttgcagggctcctgctgctgggatcagctcaccttcctcacagctctggatcctcagcaagatggggggtggagctgcggggggcatgaagacaagacctggtggtcagggaggggtgactcaccttgcgttatacctctgacctcagaaagtccttaatcttgttcctgtgctgccccctgtaattctagtccacagctgttggttctgagctgaaaaatgagctttttgtgggtactctgagtctttttgtgggagtgggcctgaaggctcagactctaagaaaatggcctcctcccccacgctggcctctgggtagtgggtgggaggctgagggtggaattgacagatggtgcggtgtttaacagatgacgggaaacaaaattactcagctgccgtgtctctccatcttccccatggaaggagatggccttcggactggaaacagacaatgacctcaatcaggaggctgtcagaggacagggaaagagagaagcgacggggtattaggggtattagggcaccatgaacaggtgtacaaaagacctgactcagaatcccatccctgccacacaccagctgggtgatcttcagcagatctcacagagtctctgttttctcatctgtaagatgggtcaatgaaaaaccctgccttatcttcctcactggcttttatgaagattatatggattctgtgtttgaaagatgggctttaaagacttgcgaaggtgtaaagatgtaagaggttatctactggaaactctaagtgccggcccactagttgttgacggaatcattttaaaaactttttttttccttacaacaaaacagaatagagtagaaaacataacagtgctttacagtttcaggaaacgctgcttgtagttacatgtgcattcatgtgtcctgggtccagaagtaaatgtatttactgtggatgacggtcaaaaaagtgaaatactcagagtagagaatattcttcagtgatatctccagaagggaatggtggatgaatggaaactgacaacatgaaatatatcaggctaaacataaatgtaaaaatttttgtaaacaaaaatgtacactggctctgagcagctcagtgtaactgcggttggtggtgatgggtggaagggcttacgtaggacttaactgactgcccttttggtgggcaatgaagctctctctgctgtgtaagacaccttgagcctgattcctgagaatgctgtccctgaacgcccactaggcaatgaccgtggctccctcaccgtggccctgagctgtgccagagggaatgggttatttagcgagaaccttgaactcatgtgcccaggcctcccctccagtccactaggagtgcagaaggatttgcaacaggtatgctgtagtggtggtcaggacacccctgcctgaacttcacccatgacccttgtcctcacccccacccaaggggtcatagtccagtgagggtgagctggtcagagtggaccctaaatcaatcccagaccttcctggctggctctgagttacaagctgtgggctttgtgatgcagatcatgattcgggagtagggggcatgacctatggcaggtcacacaggacccctagaaagggccagagctggggtcagaggccacctcctccattctctgccctgctctgctgggtcccatcctgcatctacctagtccttcagctgggctgggccatttccccactgactgccggctccagctgtaactgccaccaagcctggaggctgggaggagaggggcttctgctggaaaaagatcccagaagaaaagaaagggatgagatgacacagtattttgttcccaaaccagactcaaaagtttcctgagttccttctctgtagatttgcccctgcaccgcccccccgccccccgccccaccaccttctcttctgattgaattccgcaagtcaagactctgggcaaaaatccagcccaaaggattagatggctggagattacgcacggcagtcagagagcaagttagggagcaagcagtgtatgttatcagggcttaagagagagcatcagagggagagagagatggaaagagccagatggcgagatgagaaagatcaagctgaagaaaaggggatgacaggcagacagaaagaggagtaccagcagaagacactgaagagagtgattgagaaataggagcggcaggcaaaggaacatccttgtgaactcctgtcagaccccagcggctgagaggtccaaaggaggttaatccataaagggcctttgcttttaatccttaagaccaccagcctgagactgcagaaggccctggctgaagtgtacctgtgtcatccaggagctatccattattttacacattaaccaacaactccatgccccactaccacaatcatttctatcaacaaaggcatacacagagagggtcaagaccaggcctggggaacttggcaggggctgggaagggatccctattgagtcctcttgaggagggaggcctggacagggcacttcaagacagggcatcaatgcaggtagaaggtagaagaatcctcacacttggccatgtgctgtggctcacacctgtaatcacagcactttgggaggctgagatgggcggatcacccgaggtcaggagttcaagaccagcctagccaacatggtaaaaccgcgtctctactaaaaatacaaaaattagccaggtttggtggcacatgcctatagtcccagctgctcgggaggctgagacagaaaagaatcgcttgaaccttggaggcagaggttgccgtgagccaagatggcgtcactgcactccagcctgggctacaagaatgaaactctgtctcaaaaaaaagaaaaaaaaaatacaaaagtaagccgggtgtggtggctcacatctgtaatcccgggtactcaggtggctgaggcaggaaaattgcttgaacctgggaggcagaggttgcagtgagccgagatcgcgccactgcactgcagcctgggcaacggagcaagactcctgaaaaaaaaaaatcctcacacttggggtacccatccaggttggctaaagctgatatacagaaataactacagaaataactccctttcctttgagccagaaacggaaccccacaaccctcctgtgcatctgccctgccaagacccagacactgcacctgaccctagaaccctcagctatagcctcaagccctgtggggtggggatgctcttccaattcctgcccagacctgccacctgctggctgacagtggcctcgcagtaacaagacccttgctgaggctggggtgattggtgctagaagtagcttctctgggcttggggaaaagaggatttgaaaagcaaaatgtgaaatccccattcacctacctacgtgttcttatggtctctctgcacaggttaaaaagactctgtccctaggccaggcacggtggctcacccttgtaataccagcactttgggagcccgaggcaggcggatcacgaggtcaggagttcaagaccagcctggccagcatggtgaaaccccgtctctactaaaaatacaaaaattagctgggcatatttgcacgcctgtagtcccagctactcaggagactgaggcaggagaatcacttgaacccgggaggtggaggttgcagtgaaccaagatcgggccactgtattctagcctgggcaacagagtgagactccctctcaaaacaaacaaacaaacaaaaataagacttcttgtccctgaccatcactcctgcatgatgctgggggtgatcttcaggccagaggagaatctggaggggaactcacatttactgaatggccgacaaggtactagatgcgggagacacagagataaccaaagtcctgggattataggtgtgagccacggcacctggccaagaatgagattaatgataactagtgtgaaaaacacaagcactgaactgtgtgcctgactcagagtagttttcaattaatagtgattgaatgaatgaattagagctaccaccaagggatgacgaactctgtgtgcagaggaaaagaaggaaacagacagggaaatatttctgattcttttatatatttttttctatcattaccaagtagtaattatctaggtggaagattcaaacattatacaagtttgaaaaacaaacccgctgggcgcagtggctcacgcctgtaatcccaacactttggtaggccgaggcgggcggatcacgaggtcaggagatcgagaccatcctggctaacatggtgaaaccccatctctactaaaaatacaaaaaattagacgggcgtggtggcaggcacctgtagtcccagctactcgggaggctgaggcaggagaattgcgtgaacccgggaggcggagcttgcagtgagtggagatcgcgccactgcactccagcctgggcaacagagcgagactccatctcaaaacaaacaaacaaacaaacaaaaaacctttttcttcacccttctcttattcctcctctttaagttaaccatgttttaaagagcatcattttgtctagaggttccccatctgggctgtacattagaatcacatgaagagatttttaaaatcctgttgcccaggttgtgccccagaccaatagtctcagaatctccagagtgggttccaggcatcactatttctaaaaagtccttaagtgattacattgtgccgccaatgttaagaatgaccattctggccggacacggtggctcatgcctgtaatcccagcactttagaaggccaaggcgggtggatcacttgagcccaggagttaccagcctgggcaacacagcaagaccccgtctctacaaaaaatacaaaaattagctgggcgtgctggcgcatgcccgtagtcccagctactcaggaagctgaagtgagaggattgcttgatcccggggaggtcaaggctgcagtgagccatgattgtaccactgcactccagcctgaaagacagagcaagactctgtctcaaaaaaaaaaaaaaccattccagctctttctatgcatttacaaaaaacacgtaaatagccagactctctctctctctctcacacacacacacgcatatgtatattgtagagacggggtctcactatgttgcccaggctggtcttgaactcctggcctcaagtgtgtgtgtatatgtgtgtgtatatatatgtatacagtatactgtgtgcctgtgtgtttgtatgtgtgtgtgtcattgcatttggctttttttccaaccatgaacaaggtggctcagagagattttcagggcaaaccatgtagatatttatcttcttcttgaagataaatggaggcattgaatggaggcataatctacaggtgcctctaacctttcctctactgatgaacatttaaattgtttctaattttttttactgttacaaacaatgcttcaaggtatattcagtatgtctttttaaattttattttattatttatttgtatttatttattttgcagagacagggtctccgtgtgttgcccaggctggtcttgaactcctggcctcaagcaatcctcctgccttagcctcccaaagtgctagcattacaggcatgaaccactatgccaggcctactcagtctatctttgctcacatatgcaagcactgttttgaaaaagatttctaaaagcagaatttctgggtcaatgtgtatgtacatttgttattttgatagatactgtcaaaatgctttccaaaaatacttcactaatttacattctccccacagtgtaagcacttcatattattaatgtttaatttttaccaaactgatgggccaaaagcaatatttcattgttattttaatttgccttttcctgcctatttgtgaggttaagcatcttttcatatgtttattggacatttgtatttcttttctttttttttttttttttttcgagacagagtttcgctcttgttgcccaggctggagtgcaatggcacgatctcagctcactgcaacctcacctccgcctcccgggttcaagtgattctcctgcctcagcctcccgagtagctgggattacaggcatgcaccagcacacctgactaattttgtatttttattggggatagggtttctccatgttggtcaggctggtctcaaactcccagcctcaggtgatctgcccacctccacctcccaaagtgctgggattacaggtgtgagccaccgcgcctggcctggccatttgtatttcttttatgaattaattgaccatgctatttgcccatttcctattgggctttttattttatttatttatttatttatttatttatttatttatttatttaattttgagatggggtcttgctctgttgcccaggctggagtgcagtggtgtaatctcagctcactgcaacctccatcttccaggctcaagccaacatttcagcctactgagtagctgggactacaggcacaggctaccatgcctggctaatttttttttttttttttggtatttttaatagagacagggttttgccatgttgcccaggttggtctctaactcctggcctcaagtgatctgcctgcctcagcctccgagagtgttgggattacagccgtgagccaccacatctgtctcctattgggcttttttgcaattaattaggaatagaggaaattctatttccaataatatgactggctggattctggactgatttttcagcataagtcatgtaaaaatgctggttgaaatacgcaaattattttaaaagtgtagatgtgctggccagatagcaagaaagtattaggttaaagtctaagggaaggcaggaactcagagaaacagacaaaggaatccttctttagtgtgaggatatttgtcgaattaggcaaacttgaacttcaaatttcacagtctctatttttgatagaaccaaggtgaggaatctaataggagattctctaaaaagctatgactccaaaggattcatcgttcatgtaagattgaacctgaaataaatctatcccgctgtcacatccagaggactttaatgaaagctgcctcagtgctgagctgatagcaaggctgtatctctgagttgtaaccaccagctgatctttgcgcttatttgcagccctggatgacccaaaactatccaagttaggtatttagtttaaagtggttcaggactggttagtacctctacatgcctggcaggaaaaaacaaaacaaaacaaaacaaaacaaaaaaacttcatattctctgaaggaagataccttagtcctcagcctcaagaaatttctaacatcattttctagggaaaataataaatagctcacagggggaaaaaaaatctctaggctgggcgtggtggctcatacctgtaatcccagcagtttgggaggccaaggcaagaggatcactggagcccaggagctcaagaccagcctgggcaacatagtgagacctcctttttataaaacagaaaaaaaaaattagctgggcatagtggcaggtgcctgtagtctcagctacttgggaggctgaggtgaaaggatcacctgatagagtgagataccacctgatagagtgagaccctgtctcaaaaaaaaaaaaaaaaaaaaaaggtaaatcataagaaatccatacctaagcattgaagtaaaacttaagaacaccaaagacaagaagaagaccttgaagacttaagaaaagaaggccgggcgcagtggctcacgcctgtaatcccagcactttgggaggccgaggcgggcagatcacctgaggccaggagttcgagaccagcctggccaacatggtgaaactccgtctctactaaaaatccaaaaaattagccaggcgtggtggtgggcgcctgtaatcccagctactcgggaggctgaggcaggagaatcgcttgaatccgggaggtggaggttgcagtgagccgagattgtgccattatactccagcctgggaaacaagagtgaaactctgtctcaaaaaaaaataattaaatttaaaaaaaaagaaaagacaatctttaaaggagacacactgaactctcaacaagataatgaaagccagaacccagtgaaatactttccacacatcatggcaccgaacaactgaaaaatacacagtcttttaaagcacacatgacgtatttggcaaaatctgatcatatactagattataaagcaagtctcgattgattttaaagatttgaccacagtgctagaaataagtaacaaaaataatttccatatgtttgaaagttattaaagacatttctaaataattcattgatcaaagaggaaataaaaatggaacaactaaagtagtattcaatgggaaatttaaggtctataaggcttatattcaaagacttgaagaaaggatgaaaattaattagctacacacatatctcaaaaaattagaaaataagagcaattccacttgtaggtatacactcaagaatactttttttctttctttctttctttttttttttttttttaagacaaagtctcaatccagcgcccaggctgtagtgcagtcatgcaatcttggcttactatagcctcaacctcccaggcttgggtgatcctcccacctcagcctcccaagtagctggcactacaggtatgtgccactgagcccagctaattttttcatttttagtagagacagggcttggccatgttgcccagtctggtctcaaactactgggctcaagcaatctgccagctttagcctcccaaagttctgagatgacaggtgtgagccactgtgcctggactcaaggaatacttttttttttcgagacggagttttgctcctgtcacccaggctggagtgcagtggctccatctcggctcactgcaacctccgcctctggagttcaagcgatactcctgcctcagcctcctgagtagctgggattacaggcatgtgccaccacgcccagctaatttggtatttttagtagagacggggtttcatcatcttggccaggcttatcttgaacttctgacctcaggtgatccgcctgcctcagcctcccaaagtgctggaattacaggtgtgaaccaccacacctggccatcaaggaatatttttccataaacaaccatgcctgtgtgttcatagtggcagaatttataatagcagaaacttggacacatcccaaatatccgttaataagacagtgcataggctgggtgtggtggctcatgcctgtaatcccagcactttgggaggccaagatgggtggatcacctgagatcgggagttcgagaccagcctgaccaacatggtgaaacaccgtctctattaaaatacaaaattagctgggcatggtggcgcatgcctgtattcccagctactcgggaggctgaggcaggagaattgcttgaacctgggaggcagaggttgtggtgagccgagatcgcgccattgcactccagcctggacaacaagagcagaactccgtctcaaaaaaaaaaaaaaaaaaaagacagtgcataataactgtggtacatcaacgcaatagagtattatacagcaatcaaaatgagtagaccatagtaacacaacaatgtgaatgaatcttagcaatatgatattaagtgataaaagtggacagcaaatgactacataaagcattatatgcttctaaataaaatagctaaaattgtatatgtatatatacataatataaatactctgaagaatacatgaagaggtagtaaaacaatatataaaggagagcaaaagaataatggacaagagactaggattatagctgccttggatgaggagaggccggggctatgtcagggaaatcatgttaaactgtaaagtgttatcaagattgaggccaggcgcagtggctcacgcctgtattcccagcactttggtgggattgactcacagttccgcagggttggggaggcctcaggaaacttacaatcatggcagaaggggaagcaatcataacctttttcacagggcagcaggaaggagaagtgccattcaaaaggggaaaagccccttataaaaccatcagatcgctgggcgtggtagctcatgcctgtaatcctggcactttgggaggccaaggcaggcagatcacctgaggtcaggagttcaggaccagcctggccaatgtggtgaaatcctgtctatactaataatacaaaaaaaattagccaggcgtggtggcgcacgcttgtaatcccagctacttggaaggcaggagaatcgcttgaacccaggaggcggagtttgcagtgagctgagatcgcgccattgcactccagcctgggcgacaggagcaaaactccgtctcaaacaacaacaacaacaaaaaccccatcagatcttgtgagaactcactatcacaaaatagcatgggagtaatcgcccctatgattcaattacctcccactggatccctcccatgacaggtgggaattacgggaactataattcaagatgagatttagttgggggacacagtctaaccatatcagtcctcatatggtggaagcggtgaggcagctctctggggtctttttttataaaggcactaactaccccctaaaaagtctcaccttctaataccatcaccttgggggcttaggatttcaacatatgaattctgggggaaacaaacactcagatcatagcgtatcccatgttcagggaggagagaagatctaacattatgaggcagtcaattttccccaaattactctataaattcaaataaatgcctatcaaaactgtagcaaaaattttaaaagaacccaacaatcttatatgcaattttacatgagagaataaaaatcaacttcaaaaaagaaaatcagatatggagaacttactctatcaggtagtcagagagactacaaggctagagtaataaaatcagtgtagcattggcacaggaatgccctcataagatgctataagataactgaaacatagcataaaacataaaagagaactcaacgtttacatgtgataaaaacgacaccacaaatcaagggagagagaattgtttaatagatggagttatcttgctaaatggagaaaaaaataaggttggatcctttattagtctgttcaggttgctttaacaaaatacacaggctggatgggttacacaacagaaatgtattttctcacagttctggaagctagaaatccaaaatcaaggtgtcagcaggattggtctccagagaggcctctctccttggcttgtagatggtaccttctgactgtgtcctcacgtgtccttttcttgtgcaggcacagagagagagagttctggtgtctcttcctcttcttataaggacaacagttctattggattagggccctatcctgccctaataacttcatttaaccttaattacctccttaaaggccctgtctccaaacacagtcatttttggtgtcagggcttcaatatatgaattggggttggttgagggagacacaatttagtctataacagattatttcttcaatattataaaagtgaattccagatgaattaaagactaaatattaaaaataaaactgcaagattaataaaagaaatgaagatctttgtgatcttggagtagaaaattcttagtaaacaagaccctgaacacaaagtataaggagaaattctggtgaatttaaccatatcaaaattcaggagctatttcaatgaaggtcaccatagataaagctaacagaagggtttatatagtacagttgcctcatctataacccatctgacaatggctttattatctagaatattaaaagaattcctgaaaaatcaataagaaaaggataggaaaattcaatagaatactgagcaaaggccatgaacagtcaattcacaggagggaaaacaagattggccagcagggcatgtggagagatgctcaccttgttgataatcagaaaaattcaatgtaaaatagcaatatcgctttatagttctatcagattgacaaacattagaaggctgaataatgacatgtgttgtctaagacgtagggagactcttatgcactgctggtaggcacacatggtgaaacagagtgcaacctgagtatccactcagtaagtgtgtatgtgccctgtgatctagtgatctcagagaccccgatgggtccacaactagatacgtatgagggtgttcactttggcattatttatagtgacaggaagttggaggcaacctaagcatctattgcaggaagaagggataggctaaatgaggtggatgcacactatggaattctataagcaggaagaaagagggaagaaagagggaagaaagaaagaaaaaaagtggtgcactctacatctttcatcaagacagtgttaattatagtgaaccccaagtttctcttcaaagaatcagtatgtcagtatgttcagctctcttattctttgattatccattttaaagtttagcttcctggttctcttccgttcccttgctcctggttttagtaaacaactttccctctagtcctaatcagtagttcacatctgttctctggtcagctgctccatcctgactcatcccgtttatctgctttgacctgagtcatcccagtcacctgctttgacctgagtcaccctggtcacctgctctgatctaagtcacctttagttccctgttcctaactgtccttcccgccaaactacccaccccgccactctaactcatatccctgctctctttaaaatagccaatcggaattagcttaggctgtgcggtccaaccctagccaataggggaacgccacagcagtagggccgtgtgtcaggaataagaactccttctcctctcctgtccaggtgtgctcttgccattgttccattcacgactcgcacccttctatagaagtaaaaattgccatgctgagaaaattaaatttatgttcgagtgctatttccttgcagcattgaaaatttatttacaacaacagcatgaacttttttcctagaatccctatccatcagacttctgtttgcatttcattggccaaaactgcattacatgataacacctaactgaaaggtaactagagagaaggggagttatgaacagggattgtgttagataatcagagatgtctggtttatcatctgatagatttttttctaactgctgtatagaattccatagggtgcatctatcccattttgctgtgatggctagaggtttagcagccatcttgtgccaaggaggaaaagtcaagagaatcccagagaaggccctgacaagtttcttaaccaacatcaacagtttcctattcctgaactttttatcatgtattaaaaacaagcacctctttgtttaagctacatgtgtcagagttcaattgcagacaacagaaataaatctggacctggtgcagtggctcacgcctataatcccggcactttagggggccgaggtgggctgatcaactgaggtcaggagttcaagacctgcctgaccaacatggagaaaccccgtctctactaaaaatacaaaattagccggggtggtggcacatacttgtaatcccagctactggggaggctgaggcaggagaatcacttgaacccgtgaagcggaggttgtggtgagccgagatcgcgccattgcactccagcctgggcaacaagagtgaaactctgtctcaaaaaaaaaaaaaaaagaaagaaagaaagaaagaaagaaagaaatctgatcagtttaaacagaaagggatggagaagcaggcttaggtccaggaacaacccccagctttgagagtcacatgacctctgcctgtgattgagaaaacaacagtcactactacaggaagctgatgaatcaggaagctgctcaccagagccttgctgctgctgccatgacctgtgacagcaaaacggatgtcccatgctacgtagctctgttccaaatttatatcttgcacaagagcaggacgcaaaccacagagtcatagctcaagggaatctgggaagggttgttttagctttccaacttctgcagcgcagaagaaacactgaaagcagttttagattaatgttgaggagcccgtctattatggacaacataccattcagctttttggttactaaaaaccaaatgcacatccaactgatacactgcacctaaagcaataaggatggagcttaagtgaaaaagaaaaaactaacagaataagttctatagcacaattcataacatgttagttaaaaacacatacaagcagagcatggaggctcatgcctgcaatcccagcactgtgggatgccaagacaggaggatcacttgatgccaggagtttgagaccagcctgggcaacaaagtgagatccccatctctacataaaaaagttagacaggcgcggtggcacacacctgtgtgcctccgagaagctcgtagcttctcgggaggctgaggtgggagaatcacttaagcccaggagtttgaggctgcagtaagctatgatcatgccactccactccagcccaggtgacagagtaagaccctgtttctaaaaagaaaaaaataaaataaaaacacacaaatcagtactatctttttcaatgaaatgtacattttcaaggatatacaagtgccagttggtaaagggtggaggagaatgggatgtggggattaagggtgaaagagagaaactaaagaaagtaaaacaaaacaagagagaggtcttgtacagtctgatgatgggagtgataccaatgggggaatatcattggctccattttctacatctgtggaccaagaccaatccatcaagcttaatatgtaatataaatattaaagaatattttgataacaatttatcattatattaacagatcatttaatttaaatatttcatatttaatttatcacactgaaactaatctattaaatttcatacatcataatttctggccaatccctccctcactactgcctgccgcactttgtgccccgactgcccacctgcactagacacataatgtcggtactcacaatttcgtttgtttgtttgttttgttttttgagaaggagtttcgctcttgttgcctaggctggagagcaatggtgcgatcccggcttactgcaacctctgcctcccgggttcaagtgattctcctgcctcagcctcctgagtagctgggattacaggcgcccaccaccaagcccagctaatttttgtatttttagtagagacagggttttgccatgttagccaggctgttcttgaactcctgacctcagataatccacccgtcttggaatctcaaagtgctgggattacaggcgtgagccaccccgcctggccacaatttttttttaaaaggaggtctccctctgttgcccaggctagagttcagtggcgcgacatcggttcattgcagcctcgacctcccgggctcaagcgatcctcccacctcagcctcctgagtcgctgggataacagacgtgagccaccgggcccagctctatactcataatttgacaattatgtttttatttccccagaacctcaaaaaataagttcaggtgacccccctggagaccccaccccagggtcattctgagagtaccaaccctatttaatgagatacctgcattcactcaccccctctcccgcaaccaccccttcagcaagtcgcgctccacccaattaggaggggctttaggctgggcctaaaaagttgggccaagaccccacgaggcagcatctccgccggcgtccccaaggctgagagtgggcgcgtccgtcaggaggagtcgtctttgtgagcccgccccggcggggaggagctgcccggctcaggccccgcccacccggaggatcttggggctggtctgagtccgctcctgagacgtgaccacccgccccgcatggggccccagtcccagctgcttgatccggctcagccccgaggtgtttgcagcagctctttatgaaagtccagccatctgttacctgcgttgcttcctggggagggatagtccacctggaggcattcggagacccagtgattgtgctccgcggagcctgggctgtgccccgcgttgactgcctcatagataccctacgaaccccaagtaagaaaaaacgacgaccctctctccgtgagtctcactggggtgctgacctagagtgaaccctgcttgcttagggctcctgacccagcgcttgtcctttctcagggtggatggggcgagacccctgctgggataaatgttttccctggggcaagggctgtgcacttcgcagctgctgggtcccctccctaggatccagggagacactcactactcctctccattctgtgttttagatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggagggtgagatgtcctggcttcccagaacagctgggggcatctttgcatccccaccacaccgtcctggcctggctccctgagaggggttcaggggcaatacctcctgcagtcctaaggaggaagggaatggttaagggcgggtcttcacggggtttggggcaggctctgggacagatatgggtttagagggtgcaaggggccctggagtggcccagggggaaagcaggggatctgagctgcccctccctcagacaggcctcatggtcgcatgctaccacggcttccagagtgttgtggccctgctcagccactgtcctttccttgatgtgaaccagcaggacaaaggaggggacacggccctcatgttggctgcccaagcaggtgtgaggctgctgcaccccacttccgacagcccccttttgatgcagacagggcctcagccccacccttgttgcacggtgttctacaccagactctgtcatgctgggtggagggcggtttgggagcttcatcaccccctttcctggggaccaagcttacccttgctgccctgcaggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgtgcggggcctggaccggggtgtgtggcctccagtccctcctccaagccttcccaccagacactaagtcagctgtgattatttgcagaaaggagagaggtggagatgggggatcaatctagttcaccttcctggaggggggggcacatgatttgggcttcgtacaatcaaccaagtcctgctattgatagctcagacattgtgtgtggaggtcccaggaaggaaagtgtgggaggggaacctagcccagctggaaaatctaacacgaaaaaaggctggcatctggaaccagcccctgttcctagctgagtggcttccctctttgggcctcaccagtattgtgagggtgttagctttccctgggactacctccaactctgacaagccaggcttccaggggatccagggaagtgtcgttgaggcctgtggctctgtggggtcgttcagggggaggtgcggtgaagtccacattgtccatggagttgtttgggggcccttcttccccgcagtggggctgccctctgctggtcactctgggggacccctgcctccatttttcccttccccacacaccccactgggtttggagtgaaaaaggagtgaatgaaaaaggagggcgctctacaccctttcttttgtcttagagtgactgctcctcccacaaccccaagatgggagagggagatggtgagaagagaagaaccaggagagggaaccagccgatcatccccacccacctgccccagagggtgcagctcaggcctctgcctgtcctgggcagcctgcaccgctgctctgctcagctccttggattgaggagatccctattctgccctaggtggagccccacaataggtctctctgaagtcttttcccctctctggacctaagtgtcttaatctctcttaaacaggaggttgcaacactggcctccctgattccaccttcaacaggatgggactctatggcttcgaatgtaacccacatcagtcttgctcctaaagaatctgcccttccacaaatcaccaacccctatcccgccccatgtcaccccctgtgctccttcccaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttaggtactgccccgccccctcccctggttccccagtccccgccagggagtccccagaggtccccgtgggtcttcgtcccctaccagagccctcagggcatattgagcaagtgccttcagtggctacaacccagggatagcaccagccccaggccccaagtccccaagatcctcctctccaaggcatcctcatcctcccaccagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggagtgcctccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtggaacagtgtatatggcatattattatttgtcgaagtaaaattttcacgaagataaacatgactaagacaaatatatagcgagtactaagatttatttaactacttaatgagtgaaccagcaggatagatcaaaaaaaaaaaaaagaaaagaaaagccattattgacaatcagtgaaaaaatgaatgctagaataagattgcaaagttagacacaaaaaagttaattgacacctggcaataaagccataaccatttttatttttttctactagaccaaaataatttgccacttatcaatctttaacaggttaatctgtctttttagagagcctgggtccttatcaatagtaaatattaatagcatgtcaaacaaagttaacttcccctagatgacccataggtggggttattagccaatgatctaaaatatatttgaaagggcactaactttattttttggccttatttacaagttttggatatttttctcaaacttttgttgtgtaaatatatttgcttgtatgtttataataatgatagcaactacttagaaggtgcttactatttatagtaacacatttaacccttccagtaatcctgaggattttatctttgaggatatgaggcacagagaagctaaggaattgcctaggtcccacagctagacactggcagggctcaagattgagatctagccatccagtgtggcctccaggctttaacgctaacccccaatgcggtactggagcatccctgggaagaacacagtagtgttctccagaaaaggactgaacagatttattcagatttccttaatttttttttctttttctttttcttttttttttttttttttgagacagagtctccctctgttgcccaggctggagtgcagtggtttgatctcggctcactgcaacctccaccttctggattcaagtgattctcctgcctcagcctcccgtgtagctgggattacaggcgtgcgccaccatgcccagctaatttgtgtgttttcagtagagacagggtttcactgtgttgatcaggctggcctcaaactcctgacctcaagtgatctgcctgccttgacctcccaaaatgctaggattacaggggtgagccactgcacccagccctaatgtcccttttctatcccaggattctatccaggatcccctgttacatttcatcatcacatcccccagaatcctcttgactgtgacagtttctccgatttcccttgttcctcatgatcttgacagttttgagtcatattggtcatgtattttgtgcatgtctctcaattgaggtttgtctgattttttttgttgttgttggtggtgtgtgtgtgtgtatttttgatagagacgcagttttaccatgttgcccaggctagtcttgatctcctgagctcaagtgatccgcctgccttggcctctcaaagtgctgggattacaggtgtgagccaccatgcctggcctgtctgatgtttttcttataattaatgtaagactgggtctttgggttttcagaagggaaaattccacagaggtaaagtttttctcacatcatgtcaagggaggcatatagtatgaacatgacttatcacttgatatagacctcaatcacctggctcaggtagtttgtcagttttctccactgtaaagtttctctttcttccccctctctgcactgtcatctttggaaggaagtcttatacaaggtccacactaacagagtggggagttatacaccatctccttgagggtagagtatctagataaattatttggaattccgcacagggcgttttgactttctaattatgtctaccaaattttgaaacattaaaaaataaatccactctttgaatagggaaaatacacccccccaaacacacacacacactgagaagaaaatgactaatagggtcagataatatatgatttctcccagaagagctctgaaggccactatggtggactggaagggactcaagggtaacttgatcctgaataaggcacttaaatttctcttgcctcggctttcacatctgttaaatggagaaaatgggggctattggaaggatccactagctagtatgggtgaaagagttccataaactgtaaagtactatcaagaggtgacgtattaaggaagagccccggggaagtgagttggattaaacagcttcagggcctccaggatggagctagatttctttcctccccacccactgctgaaatcatggcataggaagccagccttggcattggacatcatagacagagaaagaagctacatcgatagtcgtggatcagcatcgtggcaaaatgcctccctgggagttggcctgtgaccttggacaagttacttacactttctgagcctcacaggtgtcacttgcagaatagaggtaagagtaacatgttcaccatagggctgttataagaattgaatgagatgacgcagcacttggcatcatacctggctctatctatctgtatctatatctatatattttgagatatggtcttgttctgctgctcatgctggagtgcaaggttgtgatcatagctcactgcaggcttgaactcctgaactcaaaggatcctcccgcctcagcctcccaagtagctgggactataagtgtgtgccaccacacctggaaaactttttaatttttttgtggagataaagtctcactatgttgccaaggctggtctcaaactcctgggctcaagcgatcctcctacctcagcctcccaaagtgctgggattatagttgtgagccaccacgcctggcccattttcttttctttctttctttcttttctttttttttttgagatggagtctcatctctgtcacccaggctagagtgcagtggcttgatctcagctcactgcaacctccgcctcccaggtagctgggattacaggcatgcgccatcacacctggctaatttttgtatttgtagtagagatggggtttcaccatgttggccaggctggtcttgaactcctgaccttaggtgatccacccgcctcagcctcccaaagtgctgggattacaggcatgagccaccgtgcccggcctctgttttcttatttaatctgcacagccttcctattttgcagttgaggaaattgaggctataaagtttaggcaacttgcccaatgtcaccaattggtaagtggcaaagcagtgcttggagctcaagtctgtgagattccaaagcctgcgctcattccactgtagcacatggcatctgcttgcagccagggaggattaaactttgagcctctgattctttgagcctctccctccacctccaacctgctcagggacgactactgtaccttcaaggccagggaactagccctctgtggttccctaggcccctctgtcctggccgtggtggatctggtggaacccacattaatgcctgggttccaggttggagcatgttttccagcagagggagcctctctgccttggagaagacccacccttccaatccctggccatctccaggacagctagagtccccggacttcactctagcaactccccctcccatgccaagccatttctctctaatcctctaataggtcctgacaatagccttccctccccctcccagaaccctttcaggctgatcagagagagagaagccttgaggcctggagttgctgtggcctgtgcctcccaaagtcaacctctcctctaatatccctgcctccccctccctcatcacagctcctgaggcttccgaactcagtccctgtcagcagaggccaagaaatccatagtgaggcccctggctgtgcagaatgcaggcacggcaaagcctttggagtcagacagacctgggtttcagtcctggctctgcctctcccaacctgagtcacctcatgtgtaacatcaaatgatgagaccacaattgctgccacccagggctgtctgtagcccaagcagtgaggggtctgagaggcattgggcaccgcctggcacatggtcagggcatggtgggtcaacagcagcctgggattgtacctgagcagcagtgagtaagggaacagcccagggtgcagctacatggaggaggctggcggatgtgcccttgaggccccatggcctcccctgtgattctaggaaactattctggtggcccaggaaatgaaaacacacatctctgcatcccccaccctaggcccactcccagcccacctcatcaccacagtgctggcggctggaggagctgctcccggagtgtacacatgtacaccctccacctggaaggcagagggctcctatacctgggactgcagagttggctgtcccgacacacactgggatgtcagccaggcttgtgtggactcctggggaagcctactcactcccgtgtgggcagggaccatgtctgtgtccctagcctctggctcagcatggaacccatcccaggctcaaaacatgtgcatagggaagaaccttgttcaggctcctctaaggtcctggatgctcagggggtcctttatcatctccctccttctctcaggggccgctcttatccatggactggcagtgggcattccagggcatgccccaggaaaccccttgccaggaaaaggcaagggagtacatatatgtagggaggacagaggacagatggggactcactggtctgtgtcctcttttctccatactggggaacctggacaggatgccccctctccagcagtcacactttccaagtggttgggaccacacatgcgtcttctaccacatcaaccaccaggccagccacacccttaccctggcccgtctggaccttccacctatcagatctcagctggtcacaccgagagagacctaattggccacagctcacacagaagtttacatctgctctcctctctcctttcccacagggagaccttttcatccctaaggaaaatacccagatctgaaggagagggcttgaggacaaggtttaggccctcctcaacaccccagctcctgccaacttctactccagatggttagagagacacatgcagacaagccatcagcaacgggcttagaggcacagacatctacacaggcccattggcccacaaacacccagttgcacgtaacgaggcttcacatgcaggcacacatatacacacttgttcacacaggtgcacaaacactcactgaccaggaaaaaataaaaacagggcccccttttccctagattcctgacccatgccctgctctgccccctctgccccacaacaccgcatccattgccccagccatccagctccaaaaattgcctgtgtgactggttggagtttcatggtccatctatctgagcaggaattggggtgctaggggggcccaggccctgcctttaagtcctcccttcagagcttggtgtcctccttaactgtgaaaggccatgatccctccaagggagaggagagcagtgagcaggtctaaacctcactccttatttgttcctgtttactccagacccgccttggataccccgacccctatttcctacatccatgccagtgccctgcttttgggggacaaggggcagaagcctgtggatttgggggtcctggaaataagcattcacctgagggccctcagtcccaggccttctggtcctgagaagggcagagcctgggcacggatgctggaggggtgggaacggggcagaatttatggcatttcccctccagctggaaacaaaggcagattcctgtgtccagcatgagcaatccggtcccacccaccagagtggctggagctgaaggaaatcccgctggctctgacctctcccagacgtgcagccccacttccaaacattctctctcagccggggccattacctactctcagatactggggatcttttctggtccacactggggatggtcaccttaatgcctcaaactctctccccatgcagtaagggttctctcaacaccacccaagagcctgccaggctcccacccccttgccagtcaactctgcccttcctcatccaagcaaactcagaccttgctgttcattggaatggggaagtcttgatgtctccaggacctcctatgccatctggaatgctcagcacagccgtcagagcatctccaccttcaggagttccagctgaacaccccccataacaagatggttcatcttagatgattgacatgtcttccctcattgcagctcagggaagagcagggtgccgctatcctcaatcagtacagtcaagagatactttctaataccataaataggaactagaggttgggctatattacttaaatttatacaataataatataatgatcaataattagagggagaggaggccaaggtgggaggatcacttaagcccaggagttcaagaccagctgggcaacatagcaagacctcatctccacagataattaaaaaattagctgggcatggtggtgcatgcctgtagtcccagctacttgggaggctgaggcgggaggatcacttgagccagggagtttgaggctgcagtgagccatgacctcgccactgcactccatcctgggtgacagagtacagagtgagaccctgtctcaaaaaaaaaaaaaaaaaat

SEQ ID NO: 568 - DNA, 69173 bp, Homo sapiens
ttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagta

SEQ ID NO: 569 - DNA, 69861 bp, Homo sapiens
tgccagaactataggaaattgggatcagcaggataacactagataacatctagttctctttagtatcttcagccaagtgagctggggagagactgtttctagaatgtgggtgcttggtttccagtgttccaagttctgttggggtctattgtcaaggaagtgaggtcactctttggggtcccttacctggggctactcctgaagggatcttctattgccctcagcactcctggttctcaaaccttcaagcaacaccgctgggtgtcccgcatttctgacttgaaggcagcagataatgggaattctcagcctctatagttacatgagccaatttcttaaaatgaataaacatttattgagtattaatatctatacttcaataaattgcatgtatgtatttaaagtaagttaaaataatttattaattcaatgatttgagttatttaaatttaaacaatttaaattggttttgtttctctggaacaccctgtccgagaggtcatgtcataatcacctgaataatctgcaggtgcaggaatcactttgatcaacgatactcaaccatgatggattgtttagcagaagacagactgacacatttgactctgcaaagtctgggaaactctcttctttatcatatgtctcccttttcctcactgggtgcaagttaaggtgcacagatttgattctcatgcacctgattatacccaactctttggtcattccctctaaaaaaatctggaagaccatgacatctttggtttgaacaacttcaaggatttttcacgtgaacttctattcttccttcagagactgggcaggggtgttcctcctggcagcacttgcctcctgagtgtcttccaggccatcactatttccccagggactccagtagggcagagcttagaataatatttcccaagctcattggacacttgattctctggtgctggatcctaaacacactaacaaataattttcttctttatgtgtctggctataactcaatgcagccatcacaaggaaaacagataatggctactgttatgctgtgatgcatgtcaaaatcccccactccctgtgtgcagtgctgttctgattccttgatgttttggatttgggaatcacggcttgggccagaggctccatgattttcatcctgcaccggcacaagctgaaggtccaacacattcataggacccactggctgttcaggtcttcccctgagtccagagtcacctaagccatcctggtcctggggagcatctatgtatgcttttatattgtcttttccttttgtcaatttttggctctttttaatcctcttgggcagtggctggtgaacatttctgccctgagtgctctgtgttccccaactctcagactttttgtttccatcagctgtgactctgttgtctccaggttctgatttgcctgacacagaatacaaaatccactaattttatcatatatatgtatgttgtgtatttttgcacaatgttcagttgtttactcatccccaaagaattataagcacagttgtgaaactgacgttacaagggattggtgatacatacagaaaaacacctacatatgtctaactgtgtggggataatcagactatgtttgttattcatcaagcaataatattggaaaattattctttaagaaatgtaaaaataatattagttataacaatgttaaactactttaaccgtattgtcttttttatctgaggtatcaccatcctcactgattaattggttaaaatcatatataatgtatctttactttttctactttaattttaattgtttaaaataacatatatcttctaatttttctactccttcaagagatgtaactaaaacataaatatataaaaaaattatgtttatgtttagttgtatctcttgaaggaatatccaattgaatatagtcaaataacatttgactttgacaggaataatttagctatttatgtttaatattttaaaggctatatttggcattggatataccaactttctgtattcttctgaatacccatcatcttttctgattcttccaattttaacgtcttctatgttatatatagatttttaaaaatcacagttaacatctgttatttaggagttatatacaagcatatcttagtttttaacacagaggttacagcagactttgaaatattaatcatggtataaagttatttaatactttcaacctccactttgacaacattaaggcattaaattactaatcaagccaggtgaggtggctcacgcttgtaatcccagcactttgggaggccgaggcaggaggattgcttgagctagggagtttgagaccagcctgggcaacatagtgagccctagtttctacaaaaaattaaaaacttagccaggcatggtgccacatgcctgaagtcccagctactcaggaggctgaggtaggaggatcacttgagcccaggaggccaaggctctgtgtttgctctgtgtgttttcactctgtcgcctaggctggagtcaagtcacaccacttgactccagcctaggcgacagagtgaaaccctgtctcaaaacaacaacaacaaaaatcactaatccatttatgttctctctttgtgttttaattgatatgtattttttaaaaaagttggaatacttgcacaggccataagtgcacaactaaatgaaattttaacaaactgaacccaactctgtatgcatgtcttaggttgcaaaacagaacatcgtcagaccccagccacctccttgtgcccttcccagtcactacctctaggagtaaccatgactctgactcctaacagtatagctcacctgtactttcacctgttttgtagcttatatatgaaatcatatagcgtaacttattttgtatgtagattttgaattccacatgtttggaaacttatctgtatgttattgtggttcattcattaggtaggtgatagaattattaggttggttgaggtttttgccctctaaagtaatggcatcatctgaacatcaagcaatgaacttaatcatgccactgtaaatgcatatgagtagtattcatgatggggctattaggaacactagttgtttttttgtcttccatgtcggaaatagcaaaatagttcatagagatggacactgagcttttattcgagcaggaacatgacagttcaccagagaagcatagataacttcagatcctggggaagggaaggtgggcaagcagcttgggtggtggcattcatctgagaaaagtgagtgaatccctagtatgtgaaagggacagagagtctcagtaactcacgttttcaacggggatatgtggaactcaggacatggaagagcatcttgcttctcccaagccctggagcgaatttggggagaggctgggagactctgagagggaaaggcactgggaaaagctgcagacattttcccagacccaggaccaagaggaggatgccattttcaattctggctcatgtcaaggcagtcattgtttggtggctgggcagcagcagctgccacaggtatttaggtctctggtgagaaagattaaagcacttgttctggaggaggagaaggacccccataggcagaattgagcagcaagtgtggtgtgtacttccgctataggcaccggaatcggtctttctttcattacaggactggaaagggaggagatttgctgaagccatggttgctctcaggtggtgatatttatggccagaggtggctttgcaacctgggaccagtctacgtatggcatttctgggcgccccagcctgccccctttgtcagtcaggggagtgagcccaactggttctgaggatggggagggagacagatcccactcctgctcacctggatcgggagcatgggccaccacttccttcctgtgcgaagagcttggtgcagaggcatctcctctgctcttggccgaggcatgtctgcaggcatctggtgcaccctctcacctggattttgagttctgggctgcctgtccgttcccatgcagagaacatgatgcagcagcactctctctgctcatacacggacttgtctcttggcttccggcatactcactctcccagattaggagcttgagccacctctcctttccttgaaaaggtcttgttgcagtgttggtttctctgctccttgcccaggcatatttccaggcatttggtgcaccctcttgcctaggttaggagcctgagctgcccctcccttcctgggcagggatgttttttctttcctttcttttctttttctttcttttcttttgtttcttttcttttctttctttcccttcccttccctttctttcttctgttcttttctttttttttgtgagacagagtctcactctttcacccaggctggagtgcagtggcacgatctcggctcactgcaacctccgcctcccggattcaagcgattctcctgcctcagcctcctgagtagttgggattacaggcacacgccaccatacccagctaatttttctatttttattctttgggattttgaactcatagcaaccgtaacactactagttacactgatttctacgtcagctttgagcttgcttaaagtcaggggctcctgccaaacttagggctgggacctttcctgaaagttactatatttcctgaaatatagctttatatttcaattttgagatgggtcaatttggactctataaatgatctcagaatgccacttggtaaatagaaataacataatcaagaaggaaattggactggaacagaaacagctctaaaggaaaaactgggattcatctttggtgggaattttttgcccccctccattgtccaaagcaatgctgctggctctatgggaccctcccccacaacacacaattcactgagtatttactaaatgcctagtcctagttttctaatgggtcggggaaaaatgacacttcatggttccactgggctgctgtgggtgtttaacctcagtgccagccatgtggaacttgaagcaggagtggtcactccactcagtggtcagaactcaagagttttgtgtcattgactactttctagcttttggtcttccgtattgaaaactacagactatttgaatgaggacatcatctttggggctgcaaactgaaaacaatcacttgaattcaggaggcagcggttgcagtgagcagagatagcgccattacactccagcctgggtgacagcataagactccatctcaaaaaaaaaaaaaaaaaaaaaaagaaaaagagaaaaaaaagacagaatccaaatgctggtgaggatgtggagaaaagggaatccttgtacactgttggtggaaatgtaaattagtacagccactatggagaacagtttggaggatcctcaaaaaactaaaaatagagctactttatgatccagcaaccctactcctaggaatataccccaaagaaaggaaatcagtatattgattaaaaactctccataaactaggtatcaaaggaacatgcctcaaaacaataagagccatccatgaaaaacccacagccaacatcatagtcaatgggcaaatgctggaagcattcccctggaaaacaagcacgaaacaaggatgtccactttcaccactcctattcaacatagtattgaaagtcctagacagagcaatcaggcaagagaaggaaacaaagggcattcaaataggaagagaagaagtcaaactatccctgtttgcagatgacataattctatacctagataaccccatggtctcgcccaaaagctccttcagctgatagataacttcagcaaagtttcagaatacaaaatcaacatataaaaatcactagcatttctgtacaccaacagcagacaagctgaaagccaaatcaggaaggcaatcccattcacaatcaccacaaaaagaatagaatacttaggaatacagctcaccaggaaggtgaaagacccctacaatgagaattacgaaacactgctcaaataaatcagtgatgacacaaacaaatggaaaaacattccatgctcatggataggaagaatcaatatcattaaaatggctagactgcccaaaagcaatgtacagattcaatgctattcctaccaaactaccaatgaaattcttcacagaactagaaaaactatttaaaaattcatatggaaccaaaagagtgcctgaatagccaaggtaatcctaagcaaaaagaacaaagctggaggcatcatgctacctgacttcaaactatactacagggctacagtaaccaaaacagcatggaactggtaaaaaaaaaaacaggcacatagtccaatggaacataatagagaggccagaaataaggccatacagcaacaaccatctgatctttgacaaagctgacaaaaacaagcaatggggaaaagaatccctattcaataaattgtgctgggataactggctagccatatgcagaagattgaagctggacccctttcttataccatatacaaaaatcaattcacaatagactaaagacttaaatgtaaaaccaaaaactataaaatatcctggaagacatcctagacgataccatcctagacataagaatgggcaaatctttcatgacagacaccaaaagcaatcgcaataaaagcacaaattgacaaatggtatctaattaaacttaagagtttctgcacagcaaaagaaactatcaacagagtaaacagacaactacagaatgagagaaagtttttgcaaactatgcatctgacaaaggtctcctatccacaaggaacttaaatttacaagagaaaaacaaacaacctcattaaaaagtgagcaaaggacatgaacacacacttttcaaaataagacataaatgtggccaacaagtatctgaaaaaagctcaatattactgatcactagagaaatgcaaatcaaaaccagaatgagattaacacctcacaccagtccgaatggctattattaagtcaaaacaggccgggcgcggtggctcatgcctgtaaacccagcactttgggaggccgaggcgggcggatcactaggtcaggagatcgagaccatcctggctaacacggtgaaactccgtctctactgaaaatacaaaaaattagccgggcgtggtggtaggtgcctgtagtcccagctactctggaggctgaggcaggagaatggcgtgaacctgggaggcggagcttgcagtgagcctagatcgtgccactgcactccagcatgggtgacagagtgagactccgtctcaaaaaaacaaacaaaaaattcaaaacataacagatgcttgtgaggttgtgaagaaaaggggacacttacacactgttgttgggagtgtaagttagttcagcgattgtggaaagtagtatggtgattcctcaaagactgaaaaacagaaataccattagacccagtaatcccattactggatatatacccagaggaatataaatcattctaccataaagatacatgcatgtgaatgttcattgcacactattcacaatagcaaagacatgaaatcaacctaattgccaatcagtgacagagtggataaagaaaatgtggtacatatacaccatggaatgctatgcagccataagaaacaagatcatgtctttcacagaaacatggatggagctggcactgctacactgttggtgagagtgtaaattagttcaacgattgtggaaagtagtatggtgattcctcaaagactgaaaaacagaaataccattagacctagtaatcccattactggatatatcctagaggaatataaatcattctgccatacatacatgtgaatgttcattgcagcactattcacaatagcaaagacatggaatcaacctaaatgagtgacagactggataaagaaaatgtggtacatatacaccatggaatgcgacgcagccacaagaaacaacaagatcatgtctttcacagaaacatggatagagctggcagctattatccttagcaaactaatacaggaacagaaaaccaaataccatgtgttcttacttataagtgaaagctaaatgatgagaacacacagacacaaaaaagggaacaagagacactggggcctacttgagggtggagattgggaggagggagaggagcagaaaaagtaactattcggtactaggcttaatacctgggtgatgaaaaaatctgtacaacaaacccctgtgacatgagtctacctaagtaaaaaaccttcaacctatgtagcaaaccttcacatgtacccctgaacctaaagtaaaagttaagaaagagaaaaacagaaaattaaatagagggactataccaaatgtgatgagaatgtaggggaaatggaaccctcgtacagtcttcatgggaatgtgtaatgatgccacccctttccaaaacagtttagtggttgttcccttttttgaacattaaactccgaagtatttacttaagagatattgtaatatatgtctattcagcaacttgtatatgaatattcatgccagttttatttgtaatagacaaaaactagaaacaattcacatggtctccaactagcgaataaataaacaagctctagaatacaattttgcatcgaaaggcgatgaactgttgatacctgctacagtgggacttgattttatgctgtgtgattctatttatatagaattgtggaaagtgaaaatcaatctattgttactggaagcggtggttgcttagagagcgcttagggttggaaggagtgcaaaggaagaattgcaatggggggtaatcatgataaaatgtttggggggaatcgatatactcattgtcttgactgtgttgatgattccccaggtatacacatacatcaaaacaaaataaaccttctagatatgtgcagcttattgaaagttaattatactttaataaagctttttaaaaaataagctcaattgaagcctatgaaatggaagattaaaattaggcagataatataatccaggttgaagaataaataaatatgatcaacaagcgcttaatacattctgacagttttagaacaaagaaaatgaaacaatggcatgattttatcatttcgtcgaattgaaaaaataccaacatttctccatagagaatgttgttgaaggttagtagatatcagtcctttattactgactcaggatgggaaagtaaagagctacagccttttttgacttaaagggggaagagctacatatatattcattttgctatactttgcaatatacaaacacatatgaatcattaccctaatattttctgattacaaagaaatgtgtgactgttataaaacatccaaaaacatcaaatgtctaacatgaagtacaaaatttgtcagtagttttagactcaaatgaaacattttccactttgaggatattgttcaaactcctttcccaagactgtccctggttttgtcatgtattaacacagtgtgtctaaaattgcctgagaagtagcaggtctttgttctcactctcatagctgtgtcctctgttgaatagggtctgggtgcccccagctaaagcctcatttgatccactatcaggctcctttatctcctctccagggtaagggtgggtccattttcttcctaggaggagctctgagcttctccattcagggccggatcctagggaccagggagtgtggctgggatgagccagccctcagtgggaaagacataggccatctgggcggccacggcacaggtttgtaccatagcacagagtccccctggagccagggtgagctcagacagctgctcccaggtcagcagagaataggcctactgttcccacacctgggctgtgttgtgataaatggcttcagatggagtgtgcagagaggtcaccaggcttttctgaagtggcagtgggtggtctcctagagactgagatctgggccgcttgctgtgcccggtgtgggcctctgggggtcccccacagcaggcatcatgggtctcctcatttcactgatgtgtacagtgtcagagaggcctttggtttcttttccaaagtcaagcagtccttttgcactttcggctcatgtccttgatgctgtcctgaagaggaagcatgtgagtgagagacttaccagaacagctcccatggatgctcattcccagaatgtccccatgcaccttcaggtgaaccccacttgtctttcctcctccttccctgccccctctgtctccctaagcaagggaggctaaatcccttctgggaccccaaatgctttctggatgtcaggatctctaaaatcctctcagccactgagaaacccctttcctgcccaaactcagtataaacaacctgctaatctgccctttggaacaaaaaaggaagatcctacctgctctatcttggcagctgtccatggaatggatttctctcttcctagagttcccccatctgagctggactctgattctgtggataaaatgggagtttgagtgactgcctccaactgaacaccttaggcactctagtccatcctggacacaccagagctgaggtagccaccaaaactcggttcttctctgttctccagagtccaagaattataagaacctggatgccaaagagctcccagttcccttcccagaggagactgtgtttacccatccactatctcttctcaccttgaaagaatcacatcttacatagtttagcagtgctgcttctgactttgagcttagtttccttggaattctcttcctcatttgaattgggctctgatctcagtgcaaaagaaagtttaggtgactcatctcttcctaggcatagagtcccaaagtctatacctaaccgatatttgtgggtcattctctcaatcaaggctgttcagccagtgtcaagtgtgaatgggaagcacagagttccgggggatcatcaccatatttctgaaatccctgtgatgactgtaagtcatttcccgtttctaatctcaaaatgaaaccccaccaaagacacagatcagtatccctaattctacccctcctaccagactccataggaacagcccaaaggccttaccttgccttgcatgtggctcttactggaatgagaagacagtgtcttatcttttcttctgatggtctttcctccttatccaagcccctttctgtaaaggagacctgttggaaagaaggtgggtcaatggggcattggatggaggggcagtgggagtctggtcttcagttccccatcccatggtgaagcttcagtgaaaggtgatctctctctctctctctcacacatgcccagaatcaggtgcaggttgttcttgtgaacctgtttttctaagcccttaagctggacatggctcactcctactggctgaagagatttctccctcctgccactcatcatggcctcaataagaaatttttccatcatgaacaccttggggacctagacacagataaggtctagatgcagagccccgtcaccatgttaagaagcaggaattcaaagctgggggcacaggaagaggaatgcaagaaacttatccctatctgatttgtgccccaattcccacctagaagtatttaagatcctgccccgaattcaagatgcagaattagacagaccacatattgacatgtgtatatatattttgcacatgaagaaaattatatatagtgttaaaattgtgcgcatagatgttatatttctcaaatgcttggatatgacaaatatcaagttatagttcatatattagatatatgcatatgtggtaagataataatgcagagaaaaagtaaacaccaaataaaatatcctttcctagcttgaaagtgggggagatgattaggtaaaatgtgaccgcattggactgattagatcacatgtaaagctaacccaatcaactgaattcttgaggcagcaaaaagtccagctgaagagcaaaactttccctttacctcattctccctcagtcaccctgggagccccactatactctgtagagtctgctcggcatctgtgatctaagctgatccattcagctggattatcatcatcaaccttgcacgctttggttctttctctttgtgtttctgtttacaataagttgtggatatgactttgcattatgaatttccagacacctaatgggccacttgtctgtttctgtcctgaaaaaccaatacccaaatccaaaaatatatcctcacaagaacctctgaaagccacctgtgattgctgctaactcattgacctccctgctcctcaacccacagagaacatgcaataactgccagattttaggacacatggccaggatcaggaggtgcccagtgaagtgctgtggtgggaccctgtccccaaacccatgggcttaaataaaaagcagacactgaaaccaagaaagccccagcaacttctgactccaggaccctttactaagactgacagaaggaacaaagcaaaaatgagatatctgaagggttcaaataatccttgaacattggaatctttggacatcacaattccagtgtctcctcctttactttttgtccacagccttctcctggcatgaatagagaaacttaataaaaatacacaaagggctcagtatactcccaaattcctcaactcagaagcccattctattcctgaaggatcattgcaggcaggtgtatggggctatcttgaaactgcatatacaggccaaacagcaatagagtccaaattgaagtacatcctgattatacattaaagaaaaacacagaggctgcctggagttggaagttggatctgaaatgagaccaggagaatccttggtaaagtctgcaagacctttaatgcttctttcactccaaaacacaagcaaggaccgtgtcctttttcccatccgccaggtggggacaggaagttgagacatatacagacactaaacatggtttgttctgcagcaagaagattttcagagaaagatgcttcgcataacttactcaggaaacttgaagcatcagcaaaacttaagtgtaatgagataatcttattactctgagggtatttccccccgtttcctgctcaattgctcttcatttgacttgctttccttctatgaacattatctcaaaaacccaggataaccaaaagggttcctcacatatatgtacttttctttttcctttgttttgttttgctattatttatatgcccaccacaaacatgctagtgtgggcatttctacacacattttcaagcagtgttatcagatgcatttcaggaggtagaatcctgcatgcaagaacatgcatctttccactcaatacatatttgctaattgtgccttaaaaggtcattggccctttatactctctataaacatgtaaaaaaccgtgtgtgtatatgtatgtatgtatgttcactcatgcactcatttatttatttatttagaaacagggtctcactctctgttacccaggctggagtgcatgatcatagctcattgtagcctcaaactcctgagcttaaggtatccttctgcctcagcttcccaacatgctgagaatacaggcatgagccaccatgcctggctagtatgtttttacttatcatgaaaagattagtaggaagcatttaattttcctaactgatggtcacacaaaacttttttttttgtaatttattttcctgtgaccaccattgaggttagatgcatctttacgtgggaaatggccatttgtatttcttttaccataaaatgttttcataggtcctgtgccttttaaaattgagtttgtgttttactcttcattgtcagaggttcttaacatatttggatgtcacctgttccatatgatgttagtaggctgatgcctgtccacaatccaagaatagatctgtcctagatctttgttctcaaaagtcatccagttgtcaagaaacctgagatgtgatccttccacatggcaaaggttcccatcaagacatgaactaggctgccgattacctcatggccaggaaaagcatgggggatggatttattgattggccccacgttgcatccaagcactttggccagggcccaatacattgccaaaatgacagtcaacaggcctaaagtttactctcatgatgttctccagcctgccatcaaaatacttttctttttctggccacttcttcaacctctgacacattaataatattcccatatgattcatatgcacattaataattgttaagttggggaattttattcttttttttcctttgaagggtaaaaattttatttttgaggaacttcttactgcacattttccaagagagtcacataagaaagcaaaaatgttatcctcccctcatcctagaaataaataaggacataattttttttttaatcatgacacttggaggcttagcgccagcatccaaaatgaacaaaaacggaaaaaaaagcatttattttatatttcagatttctttggttggggttctccccatgcggtattaatattacttgtttcaatatctattacccaaacagtaaaaaccaggaaaaaaatataaacctagcgcttgctgaaactggggaggctgctctcttgtcttctgtgcaggaattcccaggttctcagtttgctggaaaaatttgttgacattttctttttgtagttgtttcttaaagaataacagcaaacattccaatgtccaaatcttggttcgtcttccactttattgcttggatgtttctttggtgttggtaaggctgtggcctgctttttgctttgtttctgaacggtcattaattctttaggtcaccctgccgatggtgaaggtgcctggggagcctggtgttactcagcactgctctgctcggtggatggagcagggttctcagttggtgcttcacctgccgtggcctctttgccatcttgtgaaggagcgttaggagaacgtgggcgacgccggtaattgtagggacgccggtatccacggcgaacaggcggctggtttggaccactggaggcttgctgattttctttatcttcagcctctccaactgctggggcaggtcgtgggcgaggaggtcccctgctatggtaccttgggcggtaagttggatttcgatgaaatggtccctgaagttgtgctccttctgggactccatccttcagctctccaatctcaacagcctgtattctgttgggatggggtaagaccggtgagcgacggtcaaacgtctgtcccacgtggtaaggcgggaaccgctgctgcctgtactgggggcgatactgggggcggcgcagccgattccgggccccagagaactgcctatcagtggtaggggggtcaaatccttcactgctgccgctcccttcttcctcctcctcccagcgtaatcccggggagggccatggcgccttccatagtagccacgtctgtaacggcgccaatcagcgcgtaacgactgccctccacaggaactccaccccggccagtcacactggctgcttctgcacccttctctccttaaaccacatcaaactctacagtttctccatctcctacactgcgcagatatttctgtgggttattcttcttgatggcagtctgatgtataaatagatcttctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcctggggagccgcggcggccgccaccgcaggagcctgctggagggtggtggtgatgatggtggcctcgcccgcctcgctcatgcctcctcctcctctgctctcgctcatgcgcctcggtggcggttggtcggcggttagtgcggctggtggtcgccgcggccggggctcgctctcggggaggccggggctgatctcgcggcgcaggcggcggcggcagaggtggggtcgcgcagcggaggcagctcgagcttcgggatgcgcgctcgcttcttgggctcctcgctcgatcttactgcccccttttttctctccctccctcccttccttcctccctccctccctccctccctccctcccttccttcctttcctttcttttcgtcttttttttctttccttttctttcagagtctcgctctgtcacccaggctggagtgcagtggcacgatctcggctcactgcagcctccatctcctgggttccagcgattctcctgcctcagcctcttgggtagctgagattacaggcatgcgccaccacaccaaggctaatttttgtatttttagtggagacgcgatttcaccctgttaaccaggctaatcttgaactcctgacctcaggtgatccggccgcctcggcctcccaaagtgctgggattacaggcgtgagccactgcgcctggccaggaattttattcttagagggaggtttatataggtgtactgttttctcaaaagggtacggttaagattctatctttaatgtatgtacattttgtctcacaaaaaaaccctaaaatgtggctcacgcctgtaatcccagcactttgggaggccaaggtgggcagatcacctgaggtggagttcaagaccagcctgaccaacatggagaaacccagtctatactaaaaatacaaaattaggcgggtgtggtggcgcatgcctgcaatcccagctactcgggaggctgaggcaggaaaatcgcttgaactcgggaggtggaggttgtggtgagccgagatggcgccattgcctgggcaacaagggtgaaactctgtctcaaaaacaaacaaacaaacaacccctagaataataaaacagttgtgaggggtgaggagtgggttgaaatatagatgaaacaaaaatggcacatgattggtacctgtggaggctgggtgacaggtttattacattactttgtgtattttctatatgcttgaaacgttattagccaagaattgtgtatcctgccagaataagcttcgtaaatgaagaggaaagtttttcctagacgaggaaatgctgagtgaatttgtcaacactgtatcagtacaacaggaaatgctcaaagtggtcttaaacatggaaatgaaagctcaatattcaccatcaccaaaaacacgtgtaaatataaaactcactttgtgtgtttacacaaaacaatcacacaaaggaggaagagaaaggaatcaaatgtcaatgcaacataatttcatgaaaccacaatgacaaaacaagaagaaagaatttataaaacagcttgaaaacaatcaataatatgacagaaacaaagcctcacatatcaatattgaccttgaatgtagatggattaaaatcccccacttaaaaaatgcagattggcagaattgattaaaaacattattcaactatatgctgcctataagaaattcacctgtaaagacatatacattgaatgcagaggggtggaaaaagatattccacacaaacagaaacaaaaccaagagatgtagatatatgtatatcagataaaatatacttaaatacaaaaaggtaataaaagacaaagaagttcattatataatgataaagagatcatttgagagcaagaagatataacaattgtcagcaagagaatatagcaattctaaatatatatgtacccaactttggaacacctaaaacaaatcctaccagaccgaaagaaagaatttgacgccaatacaataatagtaggggactgtaacaccctactcacagcactagacagatcaccaagagagaacatcaatagaaacgttggacttaaattggactttagaccaaaggaaattcggagacttatagaacattctaacattctatccaacaactatagaatatacatccttttcatcagcacatggaacattttccaagatagacaacatgctaggccacaaaacaagtcctaaaaaatttaaaacaatcaaattatctcagatcatagtggaataaagctagaaatcaatgtcaagagaaactttggaagctacataaatatatgaaaatttaaagcatactcctgacaaatcactgggttgatagcaaaaattaagacagaaattattttttgaaataaatgaaaaaaaaaacataccaaaagctgtgagatatagcaaaaatggtgctaagaatgaagtttatagcattaaatatctacatgaaaaagggagagagatcacaaattaacatcttaacattacatcttcagttactattaatagaaaaagaataaaccaaacccaaagttagcagaagaaaagaaataacaaagatcagggcagaactaaaggaaatagagatcaaaaaatacaaaggatcaatgaaacaaaaagttggttcttttaaaagaaaattgataaacctctagctagaataaccagaaaagatccaaataaacataatcagaaatgaaaaaggagacattacaactgataccacagaaatgcaaaagatcctcagagactatcatgaaagactgtacacgcacaaaccaagaggaaattgataaattcctggaaatgctcaaactattaagactgaaccagaaagaagtacaactcctgaacaaccaataatgagtagcaagattgaattagtgaaaacaaacaaacaaacaaacaaacagacaaaaaaccccaaagccaaaacctccccaccctcaccaaacttccaataacagcaacaaaaagctcaggaccagatggattcacagctgaattctaccaaacacacaaaaggaattaatatcaatcctcctgaaactattccaaaaaatcaaggagaagggaattctccctaactcattctacaaggccagtgtcaccctgataccaaaatcagacaaggacacacaaactacagaccaatatacttcaacagatgcaaaaatcctcaacaaaatactagaaaatcaaatccaatagcacataaaaaagataatgcactgtgatcaggtgggactcataccagagatgcaaggatagttcaatatacacaattcaataaacgtgacacatcacataaacagaattaaggataaaaatggtatgattatctcaacagatgccgaaaaagcctttgataaaattcagcatcgcttcatttaaaaatccacaagaaaccagttataaaagcaacatacctcaacataataaagcccatatacaagaaactcacagccaacatcatactgttgaaagtcgaaagcatttcccataagaactggaagatgacaaaaatgcccactgtcaccactgttactcaacatagtactggaagtccttgccagcacaatcaggcaagagaaagaaagaaaaggcatgtaaactgaaaaagaggaagtagaatttttcctgttcactgatgatatgatcttatatttaggaaaccctaaagactccaccaaaaaactctcagatttgatcaataaattcagtaaagtttcaggatatgaaattaatgtacagaaatcaatactgattctatacaccaataatgatctagctgaggaacaaagcaagaaggcaatcctagttacaacagctacaaaaaataaaatacccaggactatatttaactgaggaggtaaaagatctctataaggagaactacaaaacactagtgaaaaaaaaaaaaccaaattccataaacaaagaaaatatggcatatgctcgtgaattggaagaaccaatattttcacagtggccatactggccaaataaatctatagattcaatgcaattcctatccaattaccaatgtccttttattcagaattagaaaagaattcctaaaattcatatggaacgaaaaaaagatcctgatatggaaccgaaatagccaaagaagttctaaccaaaaagaacaacaccagagacttcacattatccaacttcaaattatactatggggctatagtaatcaaaacaacgtggtactggtataaaaatagacatagatcagtggaacataataaagagccgtgaaacaaagtcacatccaatgaaccatccgaacaaccaatctttgacaaagtcaacaaaaatgtacactggggaaatgactccctccctattcaataatggtggtgggaaaattgaatagccatatgcagaagaataaaactggacctagacctctgaccatatagaaaaattaactcaagatggattaaagatctaaacataagtcctgaaactataaaaattctggaagaaagaaaacctaggacaaactcttctagacattggcctaggcaaagaatttatgacaaagtcctcaaaagtaaacataacaaaaacagaagtagactcaattaaactaaaaagattctgcacagcaaaagaaataacaaagtaaacagacaacctacagaacagaagaaaatatttgcaaactatgcatatgacaaagggctgacatccagaatttataaggaactcaactcaacaagaggaaaacaagtgaccccgttaaaaagttggcaaaggacataacagagagagattttccaaaacaacatatgccagtggccaataaacatatgaaaagatcctaaacatcattaatcatcagagaaatacaaatgaaaaccacaatgagataccatcttacatgagtcagaatggctattattaaaatgtctaaaagcaacagatgttggtgaggctacagggagaagggaatgcttatacactgttggtgggaatataaattagtacctttatggaaaacagtatggagagttctcaaagaactaaaaatagaactaccattagctgcagcaatcccactactaggtatatagtcaaagggagataaatcactatattaaaaatatatctgcattcttatgtttatttacagcactattcacaatagtcaagatatgaaagcaacctaagtgttcatcaacagatgaatgtataaataatgtggtacatgtacacaatgggctattcagctgtaaaataataagattctctcatctgcaacaatatggatggaactggaagtcatcacattatgtaaaataagccaggtgcagaaagacaaacttggcaggttctcacttatttgtggcagctaaaaattaaaacaattgaactcatggagatagagagtagaatggtgtttaccagaggctgagaatgatatgcaccccgagcccataatccactgatggttaccagtgggtgggagagtggggataattgatgcatacaaaaaaaatagaaagaataagatatagtatttgctagcacaacagggtgactatagtaaaaaataacataattgcacatttaaaaataactaaaagagtatagttgagttgtttataacataaggaagaaatgcttggggtgatgaatccccatttacccctatatgattattacacattgtatgtctgtatcaaaatatttcatatacctcatagacatataacacctactatgttacaccgaaaaaataaaaataaaaaaattaaaatgtggtacacatataccacaaaatactcaaccattaaaaaaaaaagaaatcatgtcttttgcagcaacaaggatgaaactggaagctattttccttagtgaaataactcaagaagagaacattcaatactgtttgatctcataagtaggggctaaacaatgggttctcattgacttatagagtgaaataagtcactggagtccacgaaagattggagggcggaagtagggtgaggggtgaaaaacaactgggaagaaatttcactgttcgggtgatgggtacactaaaagcccagacatcaccactatgcaatgtatgcatgtaagaaactggcacttgtggctgggtgcggtggctcatgcctgtaatcccagcactttgggcggtcaaggcgggcggatcataagatcaggagatcgagaccatcctggccaacatggtgaaaccctgtctctgctaaaaatacaaaaacgtagctgggcgttgtggtgggtgcctgtagtcccagctactcaggaggctgaggcaggagaatggcgtgaacctgagaggcggatcttgcagtgagccgagatcgcgccactgcactccagcctgggtgacagagcaagactccgtctcagaaaaaaaagagaagaaaaaaagaaacaaacaaaaaaagaaactgacacttgtggctggctcatgcctgtaatcccagcactttgggaggccgtggtgggtggattacctgaggtcaggagttcgagaccagcctgaccaatatggtaaaacccaatctctactaaaaatagaaaaattagctgggcatagtggcgtgtgcctgtagtcccaggctgagacaggagaatcacttgaactcaggaggtggaggttgcagtgagctgagatcgcatcactgcactccagcctgtgtgatagagtgagactccatctcaaaaaaaaaaaaaaaaaaagaaaagaaatcggcacttgtgtcccctaaatatacgtaaaaaaacaattttctaaaaatgtcctgtattaaaacatttgtatgaaatgacaaggttgatttacaatgttaacttttaagatcttagttacctttggggaggaggaaagcaggttagaggcactgcagtgaacaagggagctggcaaatagcaaagggaacaggatcaccaccctgctatgcggatttagctatagcattaacaaactgtttagttcgctcacatatgtgcccttgcagcatcccacatacacctggacacatgcataagacagctgcccctgttttagaccacattaaacacctgccagtaaacgtgggtcaaaagtatacactaacatgtgtagatactgccatggaattgctgcaggccttcccttgcaaaaggccaaaccaaacggccacaattaatggcttggattgaggtcagtgtcacatacggatggccttgatacattgattgtgaccaaggcatgcattttaccagacatgatgtccaagattgggtcatgtaaaacccaagtagcagggttgattgagtggaaaagtggtatttgaaatcacaattgtgagcacactcacaattcaataccttgcatgggcaaactgtgagtcaattaaacctctttcttttataaattatgcagtctccagtattttttcatagcagcatgagaatggactgatacagcaaattggtaccacagagtggggtgctgctataagaataccccaaaatgtggaagcgactttggaactgggtaacaggtagaggttggaacactttggagggctcagaagacaggaaaatgtgggaaactttggaacttcctagaaacttggagggctcagaagacaggaaaatgtgagaaagtttggaacttcctagagacttggaggcctcagaaggcagaaagatgtgggaaagtttggaacttcctagaaaattgttgaatggctttgaccaaaatgctgatagtaatatggacagtgaggtccaggctgaggtggtctcagatagggatgagaaacttgctgggagctgcagtaaaggccacttgtgctatgcaaaagtggcattttgcccatgccctacagatttgtaaaactttgaacttgggagagatgatttagagtatctggtggaagaaattcctaagtggcaaagcattcaagagaaagcagagcacaaagtttgaaaaatttgcagcctggtgatgtaacagaaaaaaaaaagcccattttccggggagaaattcaagcctcctgcagaaatttgcataagcaatgaggagctgagtgttaatcacaagacaaaggggaaaatgtcttcagggcaagtcagagaccttcatggcagcccctcccatcacaggcctggaggcctaagaggaaaaaatggttttgtgggctgggcccagggcccccctactgtgtgcagcctagcaacttggtgccctgcatcctagctactccagcagtggctaaaaagggacaaagtacagcttgagctgtggcttcagagggtgcaagccccaagccttggcagtttccatatgttgttgagcctgcagttgcacagaagtcaagaattgaggtttgagaacttccacctagacttcagaggatgtatggaaacacatggatgtccagactgaagtttgctgcaggggtagagccctcatggagaacttctgctagggcagtgtgggaggaaaatgtggagtcagagcccccacacagagttcctactgggacactgcctagtggagctgtgagaacagggccaccatcctgtaccccagaaatggtagatccacggacagcttgcaccctgcacctggaaaaaccgcaggcactcaatgacagcctgtgaaagcagcaaggagtggggggctgtaccctgaaaagccaaaggggtagagctgcccaaggccataggaactcacctcttgcatcagtgtgagctggatatgagacatggagtcaaaggagatcattttgagctttcagatttgactgccctactggattttggactcacatggggcctgtatctccttcattttggccaactttttccacttgaaatgggtgtatttactcaatgcctgtacccctattatatctaggaagtaactaacttgcttttgaatttacaggcttacaggtggaagggacttgccttgtctcagatgagactttgacttggacttttgagttaatgctggaatgagttaagactttggggaactgttgggagggcatgattgtgttttgaaatgtgaggacatgagatttgggatgggccagggcataatgatgtggtttggctgtgtccccacccaaatctcatcttgaattgtagttcccataatccccatgtgtcaggggagcaacaagtgggagccaattgaatcatggagtcagttacctccatgctgttttcatgatagagagtgagttctcaccagatctgatggttttataaggatctttccccccttcattctgcacttctttttcctgccatcatgtgtggaaggatgtgtttgcttccttttccaccatgattgtaagtattgtgaggcctccccagccctgtggaactgagtcaactaaacctgtttcctttataaattacccagtcttgggcagtttttatagcagcatgagaatgaaccaatacattttaatagacactttctattgtaatttagagtgttcagaaaatatgatatcgggggaacctgcctccaatagtcacgtaggttcttttctatttttcctaagtgttggccggtctgagaaataaagggacagagtacaaaagagagaaattttaaagctgggtgtccgggggagacatcacgtatcggcaggttccatgataccccctgagccataaaaccagcaagtttttattaatgattttcaaaaggggagggagtgtacgaatagggtgtgggtcacagtgatcacatgcttcacaaggtaataagatatcacaaggcaaatggaggcagggcgagatcacaggaccacaggactgcggcaaaattaaaattgctaatgaagtttcgggcatgcattgtcattgataacatcttatcaggagccagggtttgagagcagacaaccggtctgaccaaaatttattaagtgggaatttcctcgtcctaataagcctgggagtgctacaggagactggggcttatttcatccctacagcttcgaccataaaagatggccaccccctgaagcggccatttcagaggcctaccctcagggacacattctctttctcagggatgttccttgctgagaaaaagaattcagtgatatttctcccatttgcttttgaaagaagagaaatatggctctgttccgcccagctcactggcaatcagagtttaaggttatctgtcttgttccctgaacattgctgttatcctgttcttttttcaaggtgcccagatttcatattgttcaagcacacatgctctacaaacaatttgtgcagttaacgcaatcatcacaaggtcctgaggtgacatacatccttctcagcttaactcatttcagcattaactaaaaagtccaaagtcttatccaagacaaggcaagtgccttctgcccatgaaactgtaaaatcaaaagccagttagttatttcctagatacaatggggttacaggcattgggtaaatacagtcattccaaatgggagaaattggccacaacaaaggggctaccggccccatgcaagttcaatatccagcagggcagtcaaatcttaaagctcaaaaatgatctcttttgactccatgtctcacatccaggtcatgatgatgcaagaggtgggtttccatggtcttgggcaggtctgcctctgtggcttttcagggtacagccttcctaccagctgctttcacaggctggtgttgagtgtctgtggtttttctaggtgaacagtgcaagctgttggtggttctaccattctggggcctggagggcagtggccctcttctcacagctccactaggtggtgccacagtagggactctgcctgggggctctgaacccacatttcccttctgcactgccatagcagaggttctccaggagagccccaaccctgcagcaaacgtctgcctggacatccatgtgtttccatacatcctctgaaatctaggcagaggttctcaaacctcaattcttgacttctgtgcacctgcagctcaacaccacgtggagctgccaaggcttggggcttgcaccttctggagccatggtctaagctgtaccttggccccttttagtcagccaagtggctggagtggctgggacttagggcaccaagtccctagattcaccacagtaggaggaccctgggcccagcttacaaaataatttttttctcctagacctccaggcgtgtgatgggaggagctgctgtgaagacctctgaaatgtcctggagatattttccccattgtctttggggttaacattcacctccttgttacttatgaaaatttctgcagctggcttgaatttctcctcagaaaatgggattttcttttctattgcattgtcaggctgcgattttctgaacttttatagtctccttttcttataaaactgaatgcctttaacagcacccaagtcacatctttaatgctttgctgcttagaaatttcttctgccatataccctaactaatctctctcaagtttgaaattctggagatctctgcagcaggagcaaaatgtcaccagtctctttggtaaaacataacaagagtcacccttgctccagttcccaaaaagttccttatttccatgtgagaccacctcagcctggactttattgtccatattgctgccagcattttgggcaaagccactcaataaatctctaggaagttccaaactttcccacatttttctgtcttcttctgagccctccaaattgttccaacctctgcctgttacccagttccaaagtcgcttttatattttggggtatcttttcagcagtgccccactcctggtaccaatttactgtattagtccattttcacactgctgataaagacatactcgagacttggcaatttacaagagaaagaggtttaatggacttacagttccacatggctgaggaggcctcacaatcatggcagaaggcaagggggagcaagtcacatcttacatgaatggtggctggcaaagaaagagagcatgtgcagggaaactcccatttttaaaatcatcagatctcatgagacttattcactattacaagaacagtacgggaaagacctgcccccatgattcaattatgtcccactggatccctcccacaacatataggaattatgggagctacaagatgagatttggatggagacatacagccaaaccacgtcagttggggtagacaaccctgtgctgtcagtcatataaatgtatatcacatacaattatatacagcatataatacttgataatgataataaatgactatgttattaatttatgtgtttactatacaacttacagccccataagctccattcatggtaagtgctctataaaggtgtaccattttttatctttcatatagtattttttgctgtaccttctctatgtttaggtatcttcagatacataaatacttaccattgtgtttcaactgcctacagcattcagtagagtaacatgctgcacagacttgtagcataggagcaataagctataccatatagcctaggtatgcaatagagtttaccatctaggtttgtgtaagtacagtttatactgtttgcaaagtgatgaaatgcctaacaacacatatctcagaacacatccccattgataaataatacatgactctatataaagtcatatcagaagacaaaatattaattaaaagtcttccacatcaaaaatctctgaatcaaaagcttttaatgataaatcttatcaacatctaataaaatattcatgctaattcttcaaaatgacttccaaaaatagaagcaacactccccaatttactctatgaggccaggagtgccataataccaaagctggacaaaagtgttgcaagaagactatagagaaaaatccctaatgactacagacacagaaatccttattaaatactaggaaacttattccaggaacataataaacatgattatataccatagccaagtgagattttattttcataaatgcaatgttagcttaacatctaaaagtcaattaagataatacacaatattacttgaatacatgacaaaaagaacatttcgatagacacagaaaaacacttgacaaaaatccaacatacattgtgataaaaaaaaaaacacagaacgctactaatagaaaaaaagtgagttctgctaaaagccatctataaaaacctacaactagcattatacttgatggtgaaagactgagtactttactgataagtttgggaataggaccataatttccacttttaaccctctatccaacactgtactccagccagggaaattgtactggaaagtaaaataaaattgtccagtttgaataaaaaaagtagaactgtgtttcattgcacacaacgtaatcttctatataaaaatttgtcaggaatttactaaaactcactagaactaagaaattcatccatgtcacaagatacaagatcaacatgtaaattgaattgtatttttatatactagcaaacaactatctgaaaattgaataaaggaaacaattccatttataatagatcaaaaagaaagaatattcatggataattttttaaattaaatttatgttccaggatacatgtgcaggacgtgcagatttgttgcatagctaaatgtgtgccatagtggtttgctgcacctctcaacccatcacctagatattaagccccacctgcattagctatttatcctgaacctttccctccccccagccccccaacaggccctagtgtttgttgtttccctctctgtgtccatgtattctcactgttcagctcccacttgtaagtgagaacatgtggtgtttggttatctgttcctgttttagtttgctggacatggataatggcttgcagctccatccacgtccctgccaacaatataatctcattcctttttatggctgcatagtattacatggtgtgtatgtacaacattttctttatccaccctatcattggtgggcatttggattgactccatgtttttgctattgggaatagtgctgtaatgaacatatgcatggatgtatctttataatagaatgatttatattcctttgggtatatacccactaatgggattgctgggtgaaatggtatttctggttctaggtctttgaggaattgccacactgtcttccataatggttgaactaatttacattcccaccaacagtgtaaaagcgttcctatttttccacagccttggcagcatctgttgtttcttgactttttaataatcaccattttgactggcatggcatggtattgcattgtggttttgatttgcatttctctaatgatcagtgatgagaatgtttgttgctttttaaaatgtttgttggctgaaaaagtcatcttttgagaagtatctgttgatgtcttttgtccactttttaatgggattgctcttttcttgtaaatttgtttaacttccttgtagatcctggctactagaccttgtcagatggatagattgcaaaaattttctcccattctgtaggttgtctgttcactctgataatagtttctttcactgtgcataaactctttagtttaatgagatcccatttgtcaagttttgcttttgttgcaattgcttttaatattttcatcgtaaaatctttgcctgtgcctatgtcctgaatggtattgcctagattttcttctagggtttttataatttttggtttatatttaagtctttaatccatcttgagttaatttttatataaggtgtaaggaagaggtccagtttcaattttctgcatatggctagccagttttcccagcactatttattaaatagggaatcctatccccattgcttgtttttgtcaggtttgtcaaagatcagatggttgtagatgtggggtcaatttccgaggtctctattctgttccactggtctatatgtctgttttagtatcagtaccacactcttttggtttctgtaaccttgttgtatagttttaaatctggtaacatgatgactccagctttgttctttttgcttaggattgtcttggcaatacaggctcttttttggttccatgtgaattttaaagcagtttttttttttaattctgtgaagaatgtcaatggtagtttaatggaaatagcattgaatctataaattactttgggtggaatggcctttttcattatactgattcttctagccatgagcatggaatgtttttccatttccttgtgtcctctctgatttctttgagcagtggtttgtagttctccttgaagaggtccttcacttccctcgttagctgtattcctaagtattttattctctttgtagcaattgtgaacgggagttaattcattatttggctccctgcttgtctcttgtttgtgtataggaatgcttgtaatttttgcacattgattttgtatcctgagtctttgccgaagttgcttatcagctcaagaagcttttgggctgagatgatggggttttctagatataggatcatgtcatcagcaaacagagatggcttgacttcctctctttttattcaaatacactttatttccttatcttgcctgattgccctggccagaacttccaatactatgttgaataggagtggtgagagagggcatccttgttttttgctggttttcaaggggaatgcttccagcttttgcccattcagtatgatcttagctgtgggtttgtcataaatggctcttattattttgaggtatgctccatcaatacttactttactgagactttttaacatgaagggatgttgaatattatcgaaggccttttctgcatctattgagataatcacttggtttttgcctttagttttgtttatgtgatgaattatgtttattgatttgcatatgttgaaccagccttgcatcctagggatgaagccgacttgatcatggtgaataagctttttgatgtgcagctgaatttggtttgccatgttttattgaggatttttgcatcaatagtcatcagggatattggcctgaagtttcttgcttttgttttcattgtatttctgccaggttttgatatccagatgatgctggcctcagaaaatgagttaggaaaaagtccgtccttttcatgtttttggaatagtttcagaagaaatggtatgagctcctttttgtacctctgctagaattcagccataaatccatctggttctgggcttttttggttggtaggctatttattattgcctcaatttcagaacttgttattggtctattcaggaattcaacttctacctggttcagtcttgggagggtgtatgtgtccaggaatttattggtcttctaaattttctagtttatttgcttagaagtgtttacagtattctctgatggttggttgtatttctgtggggtcagtggtaatatcccctttatcattttttattgtgtccatttgatgtttctctctttttttctttattagtcttgctagtggtttatctattttatttattttatttttttcaaaaaaccagctcctggattcactgatttttttgagtttttcatgtctctatctccttcagatccactctgatcttggttatttcttgtcttctgctagctttgggcttgtttgctcctgtttctctagttctttttgttgtgatgttaaggtgttgatttgagatctttctagctttttgatgtgggcattttagtcctataaatttccctcttaacatgctttagctgtgtcccagagattctggtacattgtctctttgttctcattggtttcaaagaacttcttgctttctgccttaatttcattatttacccaggagtcattcaggagcaggttgttcaatttccatgtcgttgtgtggttttgagtgagtttcttaattttgagttctaatttgattgtgctgtggttggagagactgtttgctgtgatttcagttattttgcatttgctgaggagtgttttacttccaattatgtaattgattttagagtaagtatcatgtggcactgagaagaatgtatatattctattgcttttgcattgaaagttctgtagatatctatcaggtccacttgatccaaagttgagttcaagtcctgaatattcttgttgattttctgtcttgatctgtctaatactgacagtggggtgttaaagtctccaactattattgtgtgggcgtctacatctcttttaagtctctaataagttgttttataaatccaggtgctcctatattgagtgcacatatatttaggatagttagcttttcctgttgaattgattcctttaccattatgtaatgtcctcattatcttctttgatctttgttggtttaaggcctgttttgtcagaaactaggattgcaacccctgcttttttctgctttccatttgcttggtaaattttcctccatccctttattttgagcctatatgtgtcttcacggtgagatttgtctcttgaatacagcacactgatggatcttgattgactctatccagctcgccattgtgtgtctttaaattggggcattcaggccatttacacttaaggttaatattgttatgtttgaatttgatcctgtcaaatgatgtcagctggttattttgcagacctgttgacatagttgcttcttagtgtcattggtctttgtagttccatgtgtttttgcagtggctagtaatagtttttcctttccatatttagtgcttccttcaggggctcttgcaagacaagcctagtggtgacaaattccctcagcatttgcttgtctgaaaaagattttatttctcctttgcttatgaagcttagtttggctggatactaaattctcaatttaaaattcttttctttaagaatgttgaacattgacccccaatctcttatggcttgcagtgtttctgctgagatgtttgctattagtcaaatggccttccctttgtaggtgacctgacctttttctctggctgcccttaacattttttccttcattttgaccttggagaatctgatgagtatgtatcttgggattgatcttctcatgggctatcttactgcagttctctagattttctgaattcaaatgttggcttgtcttgttgagttggggaagttctcctggatgatatcctgaattatgttctccaacttggttccattctccccatcgctttcaggtaccccaattagttgtaggtttggtctttttacataattccatagttaggttttgttcattccttttctttcttttttctctaaccttatcttgtttcagcaagataggtttcaagctctgaaattcttccctctgcctggtctatgtggttagtgatacttgtggttgcattttgacattctcgtgttgtccatcaggtcttttatgttcctctctaaactggttgctctgtttaacggttccttatgatttatcatggttcttagcttgtttgcattgggttagaacacactcctttatctcagcgaagttcactattacctgcctcctgaagcctatttctgtacattcatccatctcagcctccacccagctgcttgtccttgctggagaggtgttgtgatcatgtgggggagaagaggccctctggctttttgagtttttagagatttttgttctttctcatcttcatgagtttatctgccttcaatctttgagggtcctgacctttgtacagggtatttatggtgacttttttgttgatgctattgttgttgctttctgtttgtttgtttttcttttaacagtcagggccctcttccacagggcagctgtgttttgctgggggtccactccagacccttttgcctggattcctcccacacctggaggtgtcatcagtggaggctgcagaacagtaaagatagctgcctgctccttccctctgggatctctgtcccagaggggcactgacctgatgccagcaagaactctcctatataaggtgtctggcaatttctgttgggagtggtctcatccagtcaggagggttgggatctgggacccacttaacgaagcattctggctgccccttggcagagtcagtgtgctgcactgaggggaatcccactcatctggactgcctgaattcctcagaacaagcaggcggataaggctgatccaaagagactgtggctgtccctcccctcaggcgttcagtcccgggggatcagagttctgtccctaaacccctggctggagttgctaaaattcctttagggaggctcctccccctcagtgaggagcactgggtcagggtctggcctaaagaggcagtctggccacaatctgccacagctgctgtgctgcactgtggggaattccttctgggtccaaactgtctagtctccctggcaccagcagggaaaacatggcagtctggagctgcagtgatggctgccacccctccccccgggagctcagtcatcttaggcagcaggcagctgcagtgataatggccacccctctctctgagaactaggtagtcttaggtagtctccagccaagtggctgctgagaatctgtacagctctgtgcttggaacccaaggaactcgtggcgtgggctcatgagagggatctcttgatctgtaggttgtacagatctgtggaaaaagcaatggtttcccaggcagggtagaaggatcactcaccgcctcccttggatggggttgggcactcccgttaccctgtgtggttctcaggtgggccatggcattgccccacttttcctcactctctgtgggtcatgtcaactgtctagtcagtctcattgagagaacctgggtatctcagtgctggtgcaggattcacttgcagttttcattcttctcagtgggaaacttcaactgcagctgtttctagtcagctatcatgacccctccctcccacggataaatttaacaaaacaagtgcaaggactttacactggaagatttccttatgctaaaacaaatcaaagagctgaataaatgcaaagacatcctatgttaaatgataatattgtaaagaataccccaaaaattgacctacaaattaaatggagtcccttcaaatttcaactatagtttctatggtttttgtagaaattgacaagctttctcaaaatccacatatatatgcaaagcaaagaaaaaccacaaacacaatccttaaagtaataacaaaattcagcggggcacggtggctcacacctgtaatcccagcactttgggaggaggaggcgggcagatcacctgaggtcaggagttcgagaccagcctgaccaacatggagaaaccccttctctactaaaaatacaaaattatctgggcatggtggcacatgcctgtaatcccagctacttgggaggctgaggcaggagaatcgcttcaacctgcgaggcagaggttgtggtgagttgagatagcgccattgcattccagcctgcgcaacaagagtgcaactctgcctcaaaaaaacaaaaaaacaaaacaaaaaaagaataacaaaattctaaaactcaataaaactaatttttatttactacaaagtaacaataatcaagcctgtggtggtagcacagggatagattcatatagaacaatgaaataggtagtttcattactaaacatgcatttatgataatgtcatttgaacaaatgtgccaagaaatttctgaggaaagaaaagtcttttcaacaaactatactggaaagttggatattggcctgcaaaataatgacactggactcctaactcaaatcacacatcaaaaaacaaataacatgccaaccaaccaacaaacaaaagttaaaaagatcatacacttaaatgtaatcgctgaaactaaaaaattcttaggaggaatattaaggttttgcaaccttgcattaggcaatagtattttagattttacaccaaaggacaatcaaaaagagaaaactatacttcaccaaatttaaaatgttttattcttcaaaagccatgaaaatataaaaatggaagtcactgaatgagagaaatcaccctagctgacacttcaatatgggatttttagtctccagaattgagtacatttttgtttctaaagccagttagcaagtggtaatctggtagtgtggtatggaagccccagcaaactgatagtctattagaacaaacataggatgtcccctacagtatggctgagatgaccacagaattgaatcacgtcaatcttcaccagcacagaaaggctgcaccattgtgggaaacagccttccttatggaatattatgacaggtgagggcacaggttctgacctggcagggttatgatgatatgttttataagattaaaagttacagacaaatgttagaatagcccaaacccctcccttttctgtataaagcacccaatttagagtaatggttaagattggaggtctggaagagtagtggagctgcctgctacatggaatacttggggcaagttgtgaaaacaaaaaaaacagcaacaacatgcaaagatactcatggcctattgtaaagtaaaaacaatgcaaaagtgttttctttgatatttctagaagtatgtgaacagggactttgcacctagtcaagttgccactggggactaatggaggccaggttccttagggaatgaaactatcagccactaaattggcaaaaatataggacagggcccaggggagtttctatactcaggtttgggccctgggcccactctggtcatctcaggtccttgtctgtgatgatccttcttgtgctcactctcaagcttgcccagcagtgaccatggtttgtgatgtggcgcaactgtctgttgtccaaggaggtagaattggacctgttaaacagctcttcacttatctcctccatggaattctgcaaatagagtacccagcaaattgactgagaggtgttagtggcctgcctggcgctgttcccacaaggagatactctgattaaagttctgcattctagattaggcacagaagagcatctccatgaacctccagccagggcaaaaaccacatgacaacttgaggtctcagaatcaaatctgagtaaacaagcttaatccccaacactcaccttcccatcctgccagccatgacctggggtatgaacacagtagagttccagcacctaacaacctgctccttcccaggaagagcctcaccttaccttctgctccccacccctacacacatatatggtgatgaggagagggtatgaggttgtccagatgggatctcaagtgaggattggcctggaagtggctaccctgtggttactttggggtacctcttgccaaatgtcctgaggcatggaggttggggattgagagctgagccaatgagccaaattctgcatctttagaaaaggctctcactgaagcaagagctttgaaaagttgggatacagcagaacatcttgctctcttgacagtctctggctaagcttgataggaggctgccttcagaaatgtgagtgcctggttaccaaagttttaagttctgttggggtctttcaccaaggaagtgaggtcacttcttcaaggtttcattattcttttactaagacctacccataggcttctctgggatgctgactgctcatcttccttccccatgttattttattacctgcacacatttatgcaaacacagacccctctcacccagcctctgagaagactcagtgaagccaggaccacaggttaagaaaagctaggtcagaacctcttttcaataaatttaccagttatgtcatcctagatatgtcattgtgcttctgggggactccacagtctcccaacctgcacaatagagatcatactagttacctagttctaagatgactcatcaggagttacctaattctaaggtaactcatcagggctatgtgaaataatacaatgattgtgagttggtatcacatgtagctaatgtataaacacagagatgggagaattacatggggtgggacaactgaaacatgcctgggttttatcagttgcatgttgggaaagttgcttcccctcctggtctcatttcccaagatccaccataagggagttgaaattaaataaaatttcaataatgtcatcctgaggcaataaactttccaatatcttctcattctatttagaatcaggtccatctgtctcaccttggtctctgtggtgaaccgcctccaggatggttcacgaagatccccatttcccagtatacacaccgtgtgtaaccagtaagtggttagtgactcacctctaggcaaaataatacaactaaagatatggaatgtcacttccaatatttaattactaaaatattttcatttacctcttactttctctctctctggtacccttatttccttccttccttcccccaccctgctgtggcatatactttgctctggagaagcaagctccaatgatttgagcttctctacttacaggcttgtgtgacaaagaatggagggaatacctcgaccaacagaaaggaacccaggcctgactccaaactgaatgatgccacaactaaccagtatgagttttggaagcccatccttccccagttaagtaatagttgagaccacagctcatgagaaaccctgaggcacacaccctaactagattttctggggagttggtgtgaaagactcaggaagtatattgtaggcaaatgagtctttgggacaatcaacgaatgacccaaagcttcctctgtcttagcattgagaatatgactaaaacttcattgtgtcaaaaaaactattacatctaaacaaaaacagtgaagcatgccatttgacattgaattgtatcaacatgacatattagcctacctcctctttttaataaatctttagagaggacagaaaaatgtgaataacataccaaaataatttagtaaatgaagaatggtatgaacaaatagaaatttgataaagcagagtggttagtacttagtagcccctacaatgtgttaggaattattctaagccaattacacatggccttaatacctgaaacatgtaacacagaaattcatgaaaaatgacaaactgacccatttacaatcaatcatattaggtaacattaagaccatcatagaaataaaatgttttggtatacagtaactaaatgaacataaacatgctaaataactttattaaagtttgactaattaggtagagacaaatgggtagcatttttcaccagtaaagataagatacatattatattccagtaccagaggtgaaaaaaataaatggcaaagtgtagacctaacaatgtcatgaattttatgatagcagaaattcaagaggtcactattttctaggcaactaaaatgactctggaaatgataaattgtaaccaacaagtactacctagctatacacaaacgtcccttgtctgtttgaattaatttatagaataagtagaaatccaaatgtattcttttgtaaattcaggaacatgctaaaaaggaagcagagtgattaaagccaaaagacctgaattcaggtaaataattttatcaatattaacttaatgttatagaaaaacagtaattctggctgtatctagatcagtttctgttcactggcatgaagtatatattttcagaaatgtgcaaaaaccaaatttttaagtattaaaaaaacctactgtttacaaattactattaccacatgttctgaatgaagaaaagggatatctcataagattctgctgtatgctacacaatgtctattgaaatattttactcatgtacactggatatttgtgcttttaggaaaaatgctatatattattacatattttaatatagacaactaaaaaatcctcaagaagttacaagaacctttaagttgctgaatggagttaaaggaaagtataagaacttcacagaagcagaagtaaatcgagagaatgacccagagtagtcaaactaagaaaaaaatgcttccttcagatactcactgatcacaaggatgtcaaatctatgtgtgtttttcatcatgttcccagggaaaacgaaagaaacactggaaataatatgactatagacaccccaaatatggtatctcccaaaagagagaaccaaaggaaaaacggagtgacataataaggaagaaatgtctgaagaaaaaatatgcaacagctttgcacattggaattatatttaaaatgtttaaatgaatacaatgaaaagtagaaaatcaatgtttatttttgtggaaagaacaagaaactaaagtttaaaagccacatttgaacgacagcacaatagaatatgaataatacaaaattaagttaccagacaatgtataggttcaccactaaattaaacagagataagaggaccagtgaactagaatactgagcagaatgaatacagcaaaatacagtagaaataaaatatcataaaattttaattttaattaaagtctagaatgaggagcaaaacatgcctaattgtttcactagaacaataagtatgaattggccacagcaaataaggccagtcagatccaaggaatgggtaaacagaatctttccctccatgggagtagctaaaagcacacattgcaaagggcatggatagagagaggaatgaattgttcccattattgcaatcagtatcattatgctttgtcttgcataactgttccaagtcaagtaactagtctattaagaggctgggatgggactcagggtcaactctgcctgactccaaagcccatgaacgccatgggtccttgaggttctggagagtgccacttctgtgacagaagtaggattccttagacattctcatccatctactactcttcactattaggaataatctcctttggacaacgcttctgaagcaacttggaaggtcttcaaataatttgagaaagtgactgagggctgagtttaggaaatcaaggcccaacattattcatttcttttttttttgagacggagtttttgctcttgttgcccaggttggagtgctatggcgccatctcagctcaccacaacctccgcctcctgggttcaagcaattctccttcttcagcctcccaaatagctgggattacaggcatacgccaccacactcggctaattttgtatttttagtagagacagggtttctccatgttggtcaggctggtctcgaactcccgacctcaggtgatccgcccacgttggcctcgcaaagtgctgggattacaggtgtgagccactgcccccggcctagtcatttcttatcatcagaaaaattggaaaacacataagaacacactccacgtgtttgcaaattctcacgtttgcaaattcattttagtattttcaggttacttatgctttcagcacagattaaatcaaattactgtgcctgaaacaacctcttactctaaaagcaagtgacataaaaaatagatctgtagagagacatttcctcctgctgcaatttccaagactccaaatgcaggagtggtcataggttaaatacttgcagcacacatggaaatcacacacagctaatgcatccctcaccctgaaacagtgggtctcacccctggctccacattacagtcacatgcggaggccctacaattcccaaaacctaaattgcaacagaccaataaaatcaaaatccctggagtagggcccagacgtcagtattgtttaaagttctccaagtgattacagagtttagccaagtccccaaagtactgcttcaagccaaaattttttggtgtactagttgcaaattgtctcttgaatgaatgtaaaatgtttactcctgagttgcagcctttcagtcatacctgtattatctactcacctttgcaggaactgacctttgctactccttttgttcctgatcaacatgctccacatgtactgagtgcatactatgcccagggtcctgtgctaggtgtcctggctttcagagcatcactgtggggaaaagactttgctgggaaaaagtttcatctcaaaaaatcaaaagcatgccacttagcaaatgaaggcaaaaatggaaagacccaagaggtgcccatgagattaggacgttgatactttagaatattcaaacccatctgctaatgccatgagattgtgttccactttacaacaaaagaaaatgctgctaacattctgagatagtgagttaggattctggtgcaaatatgtaatatttaattttttattgatataccacattacatacagaaacattcatgtaaagctgtttggattataacagataatttacataactgaggaatagaaccagctttactcctacccagaaaataaatttctccctccctccctgtccaaaggtaaacaagatcctgaggtaacagtgtaaatgaatattgtacatttatacaaatgctattaaagacataaaaataaaatatatagacctgcccccagcttcaactactaatcatgtaccacttctgcttcatctatacttcaaccctttaccaacccaactcacttaatttttttaagattttttttgtgaagatgtacatacattgcaaggcataaactttaactgtacatttcagacaaataagtagacccgtataaacttcaccccttcaaagcaatattttcatcctcagaaattcacttgtcttttgtcccaggtaattttttttctcaagcagagattatctctgcattgatttctttcaccataggattgttttgcctgaaataataaaatatataaatacataaagtacaattttgtgtccaacttttctctcattgagcaggtttatgaattttatccaggatatatgcttggttttttgtattcctgagctgtattttgttctaaaagctatacaattagttcattttcttattgatggacattttggttgtttcctgttttggctattatgactaaaagataaataaatattcttgtgcaaatatatattttatattatgattcctttattagcattgacattacacttctttgcatgttttagtggttactgcagggaatacaatacgaatctttaacatatccaccaaatctacttttagagttaatactatgctgtcttaaatataaaacatgaaaagtttgctgcagaacagttccatttatcttcttattccatgtcttataaattttacgactacaaattataaatcctacaatacagtgttataatttgtttcaaacagtcacaagtctaagaaattaagaaaaaaggtattaatattagatggcagatacttaaaatatgcaaatacacttttcttttcttttttttttgagatggagttctgctcttgttgctcaggctggaatgccatggcacgaccttgattcacggcaacctctgcctaccaggttcaagcaattctcctgcctcagcctcccgagtagctgggattacaggtgccagccaccacgcccagctaatttttgtatttttattagagagggggtttcaccatgttggccagactggtcttgaactcctgacctcaggtgacccaccagcctcggcctcccaaagtgctgggattacaggcatgaaccaccacggctggcccaaatacactctttagtgtttaagtttttcctgaaatttttgaattcctcaggcactcttccctacagtaattattactgtgatgttctagtgttgatttattttgcactatccaactacattgatttgcattttgaatactgtaagatttccttccttttttccttattatatctaatctcttttatgtcagcagagatgtgtgaatattgctttattctctgggccataatacaaagctgtcattatttattgctcatattgttgcagcttggaccattgggaggtctttcaggttggctccctttgaaaagtccccatcaattttattaagcacttttttctttgtggctttacaagatactgtagctcaacttgtatttttcaacttcagccctagaattatcaatttttacatgtagccttggttccttttaatgaatggtgtttagaaaccaagattgtatacctaggtgggctcattgattacagttgcacaccaccacagccagctaatttttgtattttcagtagagatgaggtatcgccatgttggccagggtggtctcaaactcctgacctcaaatcctcccacctcagcctcccaaagtgctgggattacaagtgtgagccaccgtgcctggccagatgacagataatttgtaacacaatgagattcatttgtcactgtctgcattacatctgaatttccccaacaccctggttaattttttaaaatttgcatggagtaaaatttactctttgtggtgtacagtttattgggttttgacaactgtgtagtcacatatctatttgcacagtaccacactaaactgtttgatcatcctgcaaattttttcttgttgcccctttgtaatcaatgcctgtcctcctcccattctttggcaaccactaatcattttccatccctctaatcttttatgcaatgtcataaaatagaatcatataatatatagccttgttgatctgacagccttagagaaatgtatttaagattcatacatgtagcagtggagatcgacagtttgttctttttgttaacaacaaaaatttttttgtatagacatatcacagtttattatccattgacttactgagggacataagatttatttctagctttttgcaaatatgactatagtggcaacaaatatccacaaacaggttttaatcactagttttcagttttgcataataaatgcctagggttgggacatccggttcaaataataagtatatgactaatcttataaaaaatggttaaactatttttcaaagctactatgtcatttcacattcctaatttgagtagctccaaatcttaaccagcacttggtattcacatttaaaacaatttttttttttttaccattctcataggtgtggatatttcactgtggcttggtttccttttttaaagaattctgctgaatacagaatcttgtgttgatactaggttttcctatctgaacttaaaaaatgtaattccattgtcatttgcaactattactttttatgatatattatactgcactgaaattatttctctttttatataatttgttgctttgtcctggctgttttcaagattttttatttatctttggcactgcttttacttcaactaaatggtcagaattttgtattgtaactaaatagatcactatagagttactaatgtcttcagattaatttcgaagcaccattaaatttttttttttgagatggagtctcactctgtcactcaggctggagtgcagtggcatgattttggctcactgcaacttctgcctcccaagttcaagcaattctcctgcctcagcctcctgagtagctgggattgcagatgtgcgccaccatgcccagctaatttttgtatttttagtagagatggggtttcaccatgttggttaggctggtctcaaactcccaacctcaggttatccacccgcctcggccccccaaaatgctgggattactggcgtgagccaccatgcctggccagcaccattaaattttatgaaaacattcttaaaatccatgataacatataacaatattttataagctttcaaataagaaaatcatataattattcttacaggaatcataggcaagaaaaaaggatttgtataggatagggtctgaacccagaagacattagatttatgagagaaaaattcagtgtacaacagagaaactaattttgctttgagaatttgtgaggtttctagcatggtagtaaatcaacagttctcaaatttcctgttgtgatccatgattttcttttccatttgaagataggtaaacacatgcattttttcctgtatagttctcttacacctttttccttctatgttgatacatctgtatattccattcaatgtaagctaaagccaagaaaaatctctaagtgttcacactgaaaaagggcatgtgcaaagaaaaacactgaataaaattttataagcaatgattcaggattgtaaaagtatggattttaagtatactcccatataatctttattataactgttatagtacatcagtagctacaaaaagcaggaaagaatataatatagtaactatgaaaatgttatcaatattattggaaattgaagtcctctggaaaattgatatgaaatgtatttagaatctttcagatatgagttttcacttttatatctgtgaggcatttttatttttaacacatcaaataatattcaaagttactacttcattgtattatgctggtatttcaaataactgaccagtttttttctacttaaggaacaattgatgtaataaataaactcagaatattcttcttttattttagtatagaataataatgccctaaatatgtactatatgcttacatccattactgttttatgattcaaacacaaagagcatcttttagattttcttcatgtattctccatttaccattaaacttccatgaaattaaattgatattaataatattcatttactatagaacaacctctcatagctctgatgtagaaaaaatagactatatgtttttatataaacactaggcattaaggtataacaactaatttgagaattgaattattgtttgctttatacaaatctcaaatgttttcaatacaaataacgtgctcactgaataattacttgtccacacatcaatgtttttgctcatttgaaacacacaacaaaataaataactgctttggctttagagtaatcctccttaataaatactgctatttaatgtaaagtctggggaactgtgctttattccttttttgtgtaagtcctgacacattcagacttgagttttgattaaatacttcctcccatttattcagtctgtaaagtctgtttccctataaactctatggtgatttttaagttctaaattttggataaaactctttccacatttaccacaactatagagattctctagtatgaattctcttacgttgagaaagggtcgagcatcgattaaataacttgccacattctttacatttgtagggtttctctccagtatgaattattcaatgtcgagtaaggcatgaactataaataaaggctttgccacattctttgcatttatagggtttttctccagtatgaattctctggtggacaaaaagacttgaggaacaggaaaaagatttaccacatgatttacatttgtaaagtttttctctagtatgaattctctgatgtttagttaggtatgacctacagttaaaggctttgctgcattccttacgtttgtagggtttctctccggtatgactacttcgatgtcgagtaaggcgtgaattacgataaaaggctttgccacattctttgcatttatagggtttttctccagtatgaattctctggtggacaataagacttgaggaatgagaaaaagatttgctatgtgatttacatttgtaaagtttttctccggtatgaattctccgatgtttagttaggtatgacctacagttaaaggctttgctgcattccttacatttgtagggtttctctccagcatgaattctctcgtgctgagtaagggctgaagacattttaaatgatttaccacattctttacatttgtaaggtttctctccagtatgaattctctgatgcacaagaagatttgaagaataagtaaaacatttgctacccactttacatttgtaaagtttttctccagtgtgaattctctgatgtctagtaaaatatgaactagaattgaaggctttgccacattctttacatttgtatggtttctctccagtatgaattatttgatgttgagtaaggtgtgaacgatggttaaaggctttttcatattctttacatttgtaaggtttctcttcattatggattattttatgttttcttagacttgacaatttactaaggattttctcaccgttattacatctgtgtgacttttctccaatatggattctctgaggctgagtatgttttgatgactggataaaagtttctacacaattgttacatttggcagccttctcttgactatggatactctgatggacatggttggtgcatttatgtgagactttctcacattttttacatttgtaatgtttctgtagaaaatgagttttctgatgtcttctggggcttatgccttgtcttaatgttgtatcagatttattgtactgatttttctctgcaacacaaatatactgctaattatttagggtatagtcctgcctaaaggctgtcaaaattttatcatatgtgtgatgttttcccaaattatctattccctgacattgattaatcaatgatgaatgaatgaagacctttctatattgatcacaagcagaacgaggtgttatttgttggtgaaacaaacttttaacaaaggacccatcaaattgatcatatttagaaatcacctcttcatttttaaatctctccttttcagaaatatttgactgaacatttactccagttctatgttttaattggcttatatgattatttgaaacatggactaagtcactattcagattttccaaatttcctttcaaagaaaaggtatgtttcaaaattgatgtcgatatttagttacagaaacacatggattagaaaaagtaactgacatagattgagttttttcatgtttttgacctcttgtagcagtgatgtttttgttataggtagttgtgctacattttgtatgtccatcacaacatccgttgtgactgtcacacttaccctcactttcccactctttccttaagtgtaaattctgagagccatagctcccatatccatccaatatcactttttggaatgatgcttctatgtgcttctttctcaagaggactggagtatcatgagaaaacatatctgaaagataccaaaagttttaaaaattccaattactaaattcaggtgaaaatactttataaatctaatataaaaaattataccaagttgagaacaccatgatagttgaatcaaaaacttgaggtccctttttttctcaattgatatgtgaacttaaatataatagcatgactaaagccagttgagtttgcagtgcttaggtgaacacaaagccaagaatggttgcatttagaaggaaggaagtttgttgtatttgtgcaccacagcacagcacagttacacagaaatttttcacattctgttttgccctcagcaaagaaaaaaaaaggagtaaaacatatgtccaaagttctgggttattctggggctaaagactgttcattgcttcctttaatatgtggtgctgaagaaaatggtgatatagttgaaatgacatgtcaggtcaactgagaagaaagatgaatgcttactaccacaacagaaagacagtagtgcctttgacactcaccaaagggagagattaaaggctcctaagagaaaaaaaggcaaacctttttaataggaaaatacacacagtagtccagagaagacacatcctgacaacagtttgaagaatttcccagaatgactagagtacctgatgggtatcagttttcgcctgtacaaattcattccataaaagatgaaataggtagctgtttcttacttgatcaaaatatcaacaaaatcacaagacatcaaagtaaccaaaaaacacggctcaatcaaaggaccaaaatgaaagtgaatctaaagaagtagaaatctattaactaacatattaatatcaaagtgaagctagagaagtagaaatctattaactaatgttgagaccagctctgttgtggagaccctaaccagcagcgctagaggaattaaacacacacacacagaaatacagagtgtggagtgggaaatcaggggactcacagccttcagagctgagagccccaatcagagtttgacccacatatttattgacagcaagccagtgataaccattgtttctatagattatagattaactaaaagtattccttacgggaaacaaaggtatgggctctggctagttatctgcagcaggaacatgtccttaaggcacagattgctcatgctattgtttgtggcttagggacaccttaagtggtcttctgccctggatgggccaggtgttccttgccctcattccggtaaacccacaacctttagtgtgggtgtcatggccaccatgaacatgtcacagtgctgcagagattttgtttatggccagttttggggcctatttatggccagatttgggggccggttcccaaaaaactaattttaaattaatttaaaatatctatctttgtcttacagacaagttcttacactgtcatcaggccagagtgcaatcatagctcagtggaaccttgaattcctggcttaaagcagtcaccctccctggctttcccaagtggctatgactacaggaatgcaccatcacatctgaataatttttttaattctttgtacagacagggtctttctaggtcacctaggctggtcaagaattcctggcctcaaggaatcctacagcctcagactctcaaattgctgggataacatcagcaactacacctggcattctctgtcttctttaagaaatgaggacattaagccaacaaccatacacaaggacaaggatatattacataatgataaagggttcaattcaacaagaatattttaatatggtaaacacctatgcaccaaactttggagcaccaagattcataaaacaagtacttctagtcctgagaaaagaattagccacataataacagtggcatacttcaactccccatgggcatcattagatcattgaggcagacaataaataaagaaattttggacatcaattccacttgaccaactggacctaataggcatctacagaatagaccaactgggcctaatagacatctacagaacactccatccatcaacgataaaacacatacatctttcatatgcacacaggacacacttgatgattgaacctatatgctcagccagaaagcaagtctcaataaattaaaaaaaaatcaaaatcataccaaccatactcttggaccaaaatagaataagaacagaaaacaataccaagaagatctctcaaaaccacagaaatgcatagaaattaaacaactggctcctcaacaacttttgagtaaacaatgaaatcaaggcagaaatcaaaaagttctttgatataagtgaaaacagagaaaacacatactaaaatctttggtatgtgttaatgtggcagctaaagccacattaaaagaagtttataacatgaaatgcctactttaagaagttagatctcaaattaatgatgtaacatcacatgtaaagaaaatagaataagaaaaatgagctaagcacaaagctagcagaggaaaagaaataactaagaacagataactgaattaaattgagaccccaaattccatacaaagcatcagcaaaaccaaaagttggttctttgaaagggtaaacaagatcaatagaccactagctaggttaacaaagaaaaacagaagataagcacaatcagaagcaacaaaggggacattacaatcgaccccacaggtatacaaaagattctcagagacttatgaggacttctatgcatctagaggaaatgaataaattcctagaaacatacaatctccaaagagtgaatagggaagaaactgaaaccctgaacaaaccagtatcaagttctgatattgaatcagtaataaaaaatctaccaaccaaaaaaaggccctggacaagatggattcacaactgaaatacaccagaagtacaaggaagaactattatcaattctactcaaactattccaaaaaataaggaggagggactcctcccttctcattctatgaggccaacatcactctgttaccaaaatctggcaaagacacaatgaacaaagaaaactacaggacaatatatctgatgaacatagacaggaaaatcctcaacaaaatactagcaaaccaaatagagcagcacagccaaagttaatttaccacaattaactaggctttattcctggaatgcaaggttgttctaacatatataaatcaataaatgtgattcatcacatagaattaaaatttaaaagctgggcacagtggctcacgcttgtaatcccagcactttggaaggctgaggtgggcggatcacctgaggccaggagttcaagacaagcttggccaacatggcgaaaccctgtctctactaaaaatacaaaaattagctgggtgtggtggtgtgtgcctgtagtcataggtactcaggaggctgagccatgagaatcacttgaacctgggaggtggaggttgcagtgagcactccagccttggggatagagtgggactctgtctccaaaaaagagaaaaaaagaaaaaaatcaccatttcaatagatgtaagataagcttttgataaaacttaacatcccttaatgataaataaaaccctcaacaaactaagcattgaagaaacatacctcaaaataatgagagccatctatgagaaactcacagccaacatactgaccaggcaaaagctggaggcattccctttaaaaacaagaagaagacaagaatgcccactcttaccacttctattcaacatagtaatggaagtactatccagaaaaatcagtcaagagaatgaaataaaaggcatccaaagaggaaaaaaagaaagtaacatcatctctgctgatatgattctacacctggaaagactgtgccaaaaggctcctaaaactgataaggaactccagtaaagtttcaagatagaaaatcaaagtataaaaatcagtagcatatctatacaccaataacattcaagctgtgagtgaaatcaagaacataattccatttaaaatagccacacacacaaagaaaaaaccaaatatgtaggaatagatctacccaacgaggttaaagatctctacaaggggaactataaaacactgttgaaaaaattatagacaacacgaacaattggaaaaatattccatgctcatagaagaatcaacatcattatctagagattccatagtattcctatcaaactaccaatgtcatttttcacagaattagaaaaaaactattctaaaattcatgtggaactaagtaagagtccaaatagccaaagcaatcctaaacaaaaagaacaaagccaaaggcttcacattatccaacttcaaactatactataagcctatagtcaccaaaacagcataatactggcacaaaaacagacacacaggagcagcaccaagatggctaactagaaacagcagggtttggaggctcccatcgaaaagaaccataataagtgtgtgaatccttcaccggcaaccaaggtatccaggttctcccattagaattgactaggaggctggcatgatccatggagaggaagtaataacagtggggtgcagcagcccacctgagagccacatggggaaggaaagctccctcctgccagccaaagcatgtggtgagtgaggatgctacccagccaggaaaagcatgctttttccatggaactatgccacccactgattgcaagatcccatttgtgaacccacgccactgtggcttagcatcccaaccctggggccacgcagattctcaacagcctctcagctggaatctgcttaagcctgccaagcacctggggggaggggcaaccagcacaagagctgtggctgcctgctgtctaagccatttgagccccttggtggaggggcagcagccagcactgggactcacaactgcctaacatgctaagctcaatgggtgggggaagagcagcatctacctctatagctcccagctgcacttttccccttctggagtcagtgaggggctggttggcttggtcccaagatgtgccccccacagcccaacacactggctgtggcagactgccaccagagtgcctcttcaggccagaccctgacccatccttcctgattgtgccaggcttccctgcaggaactccaataactccagccagaggctcagggacagaacctggatctccctgggcctgagcccctaggggcaggggtaacagcagtctctggggaccagcagacttagcctttcctactggtagttctgaggaatccaggcagcccagacaagtgggcttccccccagcaaagcacaccccctccaccaagggacaaagtacttcattaaatggttcctgttccatgtgccacccaactgggtgagaacctccaacaggggttgtcagacaccctatacaggagcaatcctatggcatcaggttagtgcccctcgagttcagagatcccagaagaaggagcaggcatccatctttgctgttctccagctttcctgagtgacatctccaggcacaggagtaaaccacatgaatagtctcaggcctctgagctcaagcctgcatgtatacatctaaatggcctgaagcaactgaagaaccacaaaagaagtgaaaatagtcagttcctgccttaactgatgacattccaccattgtgatttgttcctgccccaccttaaccttaactgatcaattaaccttgtgacattccttctcctagacaatgagtctcagaacttccccaccaagcaccttgtaacccctgcccctgcccgcaagagaataaccccctttaactgtaattttccactacctacccaaatcctgtaaaactgccccactcctatctccctttgctgactcctttttcggactcagtctgcctgcacccaggtgattaaaaagctttattactcacacaaagcctgtttggtggtctcttcacacagacgcacatgacaaatagggcctgaagtgaacctccagcaaactgcagcagccctatagaagtgggacctgaccattgaaagaaaaacaaacagaaagcaacaacaacagcatcaacaacaacaaaaagtccccagaaaatccccatccaaggatcagcagccttaaagattgaaactagacaaactcaccaagatgagaaagaatcaacaacaaaaaagctgaaaacctaacaagccagagtgcctcttcttcaaatgattgcaacatctctttatcaagggtgcagaactggatggaggatgagacagaagaattgacagaagtaggcttcagaagatgggtaataaaaaactacgctgagctaaaggagcatgttctaacccaatgcaaaaaagctaagaaccttgataaaaggatagaggagctgctactagaataaacagtttagagaggaacataaatgacctgatgaagctgaaaaacacagcatgagaacttcatgaagcatacacaagtatcaatagccaaaccaaccaagcagaggaagggatatcagtgttgaaagaccaccttgctgaaataaggcatgcagaccagactacagaaaaaattataaaaaggaatgagcaaagcctccaagaaatatgtgacttcacaaaaagactgaacctacgactgattggagtacctgtaggagatggggagaatggaaacaaactggaaaacacacttcaggatattatccaggagaacttccccaacctagaagacaagccaatatgcaaattgaggaaatacagattctaagatgctccaagagaacatcaaccccaagacacataatcatcagattctccaaggtcgaaatgaaggaaacaatgttaagggcagccagagagaaaggccaggtgacctacaaagggaaatctatcagactaacagcagacctttcagccgaaactctataagacagaagagattgggggccaatagtcaacattcttaaagaaaagaattttcaacccagaattccatattccggccaaactaagcttttatagcaaaggaggaataaagtcctatccagacaagcaaatgctgagggatttcattaccaccatgcatgccctccaagagctaccgaaagaagcactaaatatggaaagggaaaactggtaccagccactgcaaaaacacaccaaaatgtaaagaccaatgacactacgaagaaactacatcaactagtacgcaaaacagccaaatagcatcatgatggcaggatcaaattcacacaagacaatattaaccttaaatataaatgggctaaatatgtcaattaaaagacatagaatggcaaattggataaagagtcaagacccattggtatgctgtattcaggagacccatctcatatgcaaagacacatataggctcaaaataaaaaggaaaatttaccaagcaaatggaagaaaagaaaaagcagaggttgcaatcctagtccctgacaaaatagactttacaccaacaaatatcaaaaaaggcaaagaaggtaaagggaacaattcaacaagaagaacgaactattctaaatatatatgtacccaatacaggagcatacaacttcataaaataagttcttagagacttacaaagagacttagactcccacacgataatagtgggagactttaacacttcactgtcaatattagacagatcaatgagacagaaaattaacaaggatgttcaggacttgaactcagctctggatcaagtggacctaagagatatctacagaaccctccaccccaaatcaacagaatatacatttttctcagtgccacatggcacttattctaaaattgaacacataattggaagcataacactcctcagcaaatgaaaaagaactgaaatcataacaaacagtctctcagaccacagggaaatcaaattcgaactcaggatttaaaaactcactcaaaaccacgcaattacatggaaattaaagagcctgctcctgaatgactcttgggtaaataatgaaataggccgtgtgtggtggctcatgcctgtaatcccagcactttgggaggccgaggccggcggatcacaaggtcaggagattgagaccatcctggttaacatggtgaaaccccatctctactaaaaatacaaaaaattagccaggtgtgttggcgggcacctgtagcccagctacttgggaggctgaggcaggagaatggcatgaacccaggaggtggagcttgcagtgagccaagattgcgccactgcactccagcctgggtgacaaaacaagactctgtctcaaaaaaaaaaaaaaaaaaaagaaataaaggcagaaatcaaaaagttctttgaaaccaatgagaacaaagagacgacataccagaatatctgggacacaggtaaagcagtgttaagagggaaatttatagcactaaatgtccacatcagaaagttagaaagatctcaaatcaacaccctaacattacaattaaaagagctagagaggcaagagcgaactaatgcaaaagttagcagaagacaagaaataatgaagatcagagcagacttgaaggagatagagatatgaaaaaatctccaaaagataaatgaatccaggagctggttttttgaaaaagttaacaaaatagactgaactctagctagactaataaagaagaaaagagagaagaatcaaatagacacaataaaaaatggtaaaggagatatcaccactgacccaaagaaatacagactaccaccagagaatactgtaaacacctctacacaaataaactagaaaatccagaagaaattgataaattcctggacacatacaccctcccaagactaaatcggaagaagtagaatccctgaatagaccaataacaagttctgacattgaggtggtaattaatagcctaccagccaaaaaagcccaggactagacggattcacaggtgaattctaccagaagtacaatgaggagttggtaccattccttctgaaactattccaaacaactgaaaaggagggactcctccctaactcattttatgaagccaggatcatcctgataccaaaaccaggaaaagagacaacaaaaaatgaaaacttcaagctaatatccctgatgaacatagatacgaaaaccttcaataaaatactggcaaaccaaatccagcagcacatcaaaaaacttatccaatgtgatcaagttggcttcatccctgggatgtgaagctgtttcaacatatgcaaatcaataaacgtaatccatcacataaacagaaccaaagacaaaaaccatgcaattatctcaacagatgcagaaaaggccgttgaaaaattcaacgtcccttcatgttaaaaactctcaataaactaggtgttgatggaacatatctcaaaataaaaagagctatttatgacaaacccatagccaatatcatattaaatgggcaaaggctggaagtattccctttgaaaaccagtacaagacaaagatgccctgtctcaccaatcctgctcaacatagtattagaagttctggccagggcaatcaggcaagagaaagaaagaaagggtattcacataggaagaaaggaagtaaaattatctctgtttgcagatgacataattttatatttagaaaacccagtcatctcagccccaaactccttaaactgataaacaacttcagcaaagtctcaggatacaaaatcaatgtgcaaaaatcacaagcattcctttacaccaacaatagacaagcagagagtcaaatcatgaatgaactcccattcacaattgctacaaagagaataaaatacctaggaatacagctaacaggggatgtgaaggacctcttgaaggagatctacaaaccactgctcaaggaaataagaggggacacaagcaaatggaaaaacattcccttctcatggataggaagaatcaacattgtgaaaatggccatactgcccaaagtaatttatagattaaatgatattcccatcaaactaccattggcattcttaacagaattagaaaaaactactttaaatttcatatggaatcaaagaagaccccatatagccaagacaatcctaagcaaaaagaacaaagctggaggcatcacactacctgacttcaaactatactgaaaggctcaagtaaccaaaacagcatgatactggtaccaaaacagatatatagaccaatggaacagaacagagacctgaggaataacatcacacatctacaaccatctgatttttgacaaacctgacaacaagcaatggggaaaggattccctactcaataaatggtgctgggaaaactggctagccatatgcagaaaacagaaactggacctcttccttacaccttatacaaaaattaactcaagatggattaaagacttaaatgtaaaaccccaaaccataaaaaccctaagaagaaaatctaggcaatactattgaggatattggcatgggcaaagacttcatgactaaaacaccagaagcaattgcaacaaaaaccaaaattgacaattgggatctaattaaactaaagggctgcttcacagccaaagaaactattattggagtgaatagacaacctacagactgggagaaaaattttacaatctacccatcagacaaaggtctaatatccagaatttacaagagacttaaacaaatttacaaggaaaaaaccaaacaaccccatcaaaaagtgagcaaaggatacgagcagacacttcttaaaagaagacatttacacagtgaacaaacatacgaaaaaaggctcaacatcactgatcatcagataaatgcaaatcaaaaccataatgagacaccatctcacaccagtcagaatggcgatcattaaaaagtcaagaaacaacagatgctggtgaggctgtgaagaaataggaacgtttttacactgttggtggtaatgtaaattagttcaaccattgtggaagacagtgcagcgattctcaaggatcgagaaccagaaataccatttgacccagcaatcccattactgggtatatacccaaaggaatataaatctttctaatataaagacatatgcacacatatgtttattgcagcattatttacaatagcaaagacatgaaaccaacccaaatacccaccaatgatagactaggtaaagaaaatgtggtacatatataccatggaatactatgcagccataaaaaggaatgaaataatgtcctttgcagggacagggatgaagctggaagccatcatcctcagcaaactaacacaggaacagaaaactaaacatcacatgttctcactcataagtgggagttgaacaatgagaacacatggacacagggaggagaacaccacacaccagggcctgttgggggtttcgggggtaaggggagggaacatagaagatgggtcaataggttcagccaaccaccatggtacacatatacctatgtaacaaacctgcacgttttgcaaatgtttcccccccaccttcttttttttagaggaaataaagaaaaacaaaaattaaaaacaaacaaacaaacacatagaccaatggaacagaatagagtacccagaaataaatagaggcacacatttacaatcatctgatcttccacaaggtcaacaaaaataagcaatagtgaaaggactccctatttaataattagatgtgggatgactgactaaccatatgcagaagaatgaacatagactcctacatttcagcatatataaaaattaactcaacatgattaaagatttaaattcagatcctcaaaaaataaaaaatactagaagaaaacctggcaaataccattctagtcattgactttggcaaagaatttatggctaagttttcaaaagcaattgtaataaaaacaaaaattgacaaatgggacctaatttaagagtttctgcacagcaaaagaaactgtgaacagaatcaacaacctacagaatgggagaagatattcacaaactatgtaactgacaaaggcctaattccagaatccatatgaaatttaaattaacaagaaaaaaaaacccatgaaaaagtgggcaaagagcaagagcagacacttctcaaaagaagacatacaaacagccaacaagcatatgaaaaaatgttacacatcactacccatcagagaaatgcaaatcaaaaccacacttagataccatttacaccactcagaatagtgattgttgaaaagtcaaaaaacagatgctggcaagtgctgcacagaaaagagaatacttatacactgctgattgaaatgtaaattagctcagttactgtggaaaacagtttggagatttctgaaagaacttggaactaccatttgacctagcaatcctattagttagtatatacctaaaggaaaatgaattgttctaccaaaaagtcacatgtactcatatgttcattgcagcactattcacaatagcaaaaacatggaatcaacctaggtgcccatcaatggtggactggttaaagaaaatgtggtacatatataccatggaatactatgcagccacaagaaagaataaaatcatgtcctttgcagcaacatggatgcagctattgtcctaagtaaattaacacaggaacagaaaatcaaaaccatgtacttataactgggaactaaatattgggtacatatggacataaagatgggaaaaagagacaatggggacttatacagagggggagtaaaggaaggaggcaagggctgaaaaactacctattaggcactatgctcattatctgggtgatgggattattcataccccaaaccagtgtcatgcaatatacccatataataaaccagcacatgtatacattgaatctaaaataaaagtcaaaagtatataaaaaaaaatagaaaagaaaaaggaaaaaaaatggggtcttactctgtcactcagactggagtacactggtacaattacagctcaatgtagcctagcctcaaattcctggggtaaagcaatcctcctgacacagcctcctgagtcactgggactacaggcacatgccacaacaactaattaaaaaaaatcttagacacagggtcttgcaatattgcctaggctggcctcaagtgatcctcctgccttagcttccaaagtagctgggattacacgcacatgtcactgtgcctagtaaaatatctattttaaagatgctcaaccaattacaggagaacacagacaaataaaagaagataaaaatacatgaagaaaatgagcttatgaactgtaaaaacacaaagtgtggagctgaaaaataactgaatttaaggattcactagagggttcaacagcagacttgatgtaggagaaaaagacccaacaagcttggtaataagttatttgaaagtttatggtcaggacagtaaaaagaaaaaaagaaaacaacagagtgtctaagggactaattgggtactatcaagtaggccaatatgctcataataggaattctagaatgcaaagagagagaaaagagtagaaaatttatttgaagaaatgatggctgagaattttccaaatttgagggagaaaatggcctaaaatttaatgaaactctaccaactctaactagtagcaacacaaagagacccacaacaagacacattctaatcagagattcaaaagttacaaacaaagggaatttagaagccaaaaaacaacaaaaaaacccccagtgacttgatatacaaggcccactcctataggatgaccagcagatggtctcagcaaaaaatctcacaggtcagaaagttgaagaatgatatattcaaagtgctgaataatgacaactaccaatcaagaaaatgttatcttccaaaactatcctttaaaaatttggaaataaagaatattcaaaatcaacaaaagccaaatgaattcatacccactagatctgttctaaaagaagtgctaaagagaaacagttcttcatattgaaaaataaaatgatggtaaatagtaacacaaaattaatagaaatataaagttttctggtaacagtaattatatacacaataaaatattctgtattatgacgacagtgcagagaatacttttaattctgctatagatttgaagtcaaacacttaaaaataaccacaaatctgtgctaatggattcacagtataaagtgatataatttgtgatatcaataaaatacaatggagggctcctaaagaggcaggatttttgtatgcaattaaggttagcagcttgaggtaaattgttataactttaagatgttttacataatatctatggtaaccacaaagcaaatacctataacagatacacagagagaagtgggaaaggaattaaaacatgtcactacaaaaatcaacaaaacactaaggaagatagcaagagaggaaaacaggaccaaaatagatacaagacctaaaacaaaaaagtgaacaaaatgcaatagtgagtcattctctttcagtaattactttctacataaatgaataaattcgaaagacaacttggctgaataaattcaagaaaaaagatccaactccatgctttccatggaaggccaaatttagatctaagaacacacataagctgaacatgaaagaatggaaaaaaataatgagaaaagtaaaatactgtcatattagttaaaatacatgttacatcaaaacatatcacaagagataagaaagagcactatataattataaaagggttcattgtccaggaagctataataaatattaacatatatgcacataacatcacacctctcaaatacatgcagcaactgggaaacttttacagaattgaagcaataagtagccagcagtacaatagtagtaggagacttccatactccactttcagtaatggaaagaataaaagagacagaagatgaataaggaaacagaggacttgaacaacactatagaccattagacctaacagtcatatacataactgaccattcaacagcagaatacataatatccataaccatacatgacacattatcacagatagacaacctgttaagctgcaaaacagtcttaccaaatttaaccagatgaaaatcacacaaagcatcacttcttactacaacagaataaaactagaagaacagaaagaaaaatggcatgtccacgaatatgtgaaaattaaataaattctcaaacacactcttgttcaagaatttgaagacaatattgttaagatgtcaatactacccattgaatctacagattcaatgcactctccatcaaaatattaatggaacttttcacacaagtattaaaatagtctaaaatgtctgtggtatctcaagagaccacagatggataaaagtcttccacagatggataaacaatcttgggaaagaaaaacaaagaggcatcatactttctgatttcaaaacatactataaagctattgtactcaaaacagtgtgctactgacgtaaaggtaaataaaagatgaaacagattggagagtccagaaataaacactcatgtagacagtaaacttattttcaatgagggttccaagaattcacaatgagaaaaggacagtctcttcaacaaacaggcttgggaatattggaaatccacagggaaaaaataaagttaccttaccttgcgcatttacaaatgtgaactcaaaatggactgacttatattttgtagctactgtaacttgcattttttattttctttttcagatggttttctatcagcacacagagatgctattgatatttatatgttgactttgtatcctgcaactttacagaacttgtttattagttctgacaggtttttggtgtcatgctttatgtttttttaatacacaaggtcattttgtctgtaaacaaggatgatttcatttttccattccaatttgaatgcctttcacttctttctcttgacttactgctctggctaggacttctagtactatgttgaataggagtggtgaaactgggtaccttatcatgttacagatctcagagaaatagctttcatcttttccctgtttggtaaattaacactagtttgtcatatttaccttgttgagatacataccttctatacataatttgcttagagttttcactataaagaatgttgacttctgtcaaatactttttctgtgtatacaaataactataaaaaattaagatacccagctataaacttaaataaaaaggtgaaagatctctacactgaaaatcataaaacatggataaaaaatgaaatacatgtgaataaatgaaaatatattgtgtttatatattggaagaatattattaaaatgggcatgctacccaaagtgacctatagatttaatgcaatttctatcagaataccaatgacattcttcacaaaaaatagaaaaaacccccacaaaaactaaatgtacatggaaccacaaaataccctgaatagccaaagcaatcctgagcaaaaggaacaaggctgaaggcatcacaccacctgacttcaaaatttactacaaagctatagtatcccaaagagcattgtactggcattaaaacaaacacatagaccaacatgcccaatgagtccataaataaattcatgcacctaaagctgactgattttcaacaaagatgccgagaacacactttggcgaaaggacaatctctttaataaatggtgcaggaaaaaactgaatatccatatgcagaagagtaagactagacccctaaccctcatcctatacaaaaaccaactcaaaatggattatagacttaaatgtaatgccctaaactatgaaactattagatgaaagcagggcaaatactttacaacatcggacttggaaagacttcaaagccaaggcaacctaagcaaaaataggcaaatgagattacatcaacctaaaacatttttgcatatgaaatgaaataacagagtgaagagacaacatagacaacgggagaaaatattcgcaaactatatatatgacaagaggttaatgtcaagtacataagaaatttgaaatctcaaaataagacaaacattaatccaattttaaaatgtgccaaagaccttaatagacattagtgaaaagaagacatacgaatggccaacaggtacataaaaagatgctcatcataattaatcatcaagggagtgcaaatccaaaccacaatgagatgccatcacactctatttaaaatgactataatcaaaaagacaaaattataactaaaacaagtattggtgaggatgtgaaggaaagagaacacatgtacactgtcgatgggattgtaaagtagtatggccactatagaagagtatggaagttcctgaaaaattaaaaatacagctgtcatatgatttagcaattccactattgggtatatatccaaaagaaaggaagtcaatgtgtcaaaaacatagctgcattcccatgtttacggcagcactctttataacagccaagatatgaaatcaatccaaatgtacaccgagataaatggataaagaaaatgtggtatacatgcacaatgaaatactattcagccattcaaaaagaataaaatcctgtcctttgcaataacatggatgaaccgtgagatatcatgttaagtgaataggccatatacagaaggataaacccttcgtgatcttactcaaatgagtaatgtaaaaaaaaaaaagaaagagagaagaaaagggctgggcgcggtggctcatgcctctaatcccagcactttgggaggccatggtgggcagatcactttaggtcaagagttcaagactagcctggccaacatggtgaaaccccgtctctactaaaaatacaaaaaattagctgggcatggtggtgcgtgcctgtaatcccagctacttgggaggctgaggcaggagaatagcttgagcccaggagcagaggttgccatgagctgagatcacgccactgcactccagcctgggtgacagagctagactctgcctaaaaaaaaaaaaggaaaaaaagttgataataagcagagaatataacagttgttaccagagactgaaggggcagaaagagaaagaggttggttaacatgcataaagttacaattacataggagaaataagttctagtgttctcttacacagcaggataacaatggttaataggagggtattgcatattacaaaatagctggaagagactagtcacagtgttacatccttgtaatctctgcattttgggaggctgaagcaggaggactacttgaggtcaggagttcaaggtcagcctggacaatgtagtgagaccctatatgcaaaaattttaacaaattacccaggcatggtggcacatgcctgtagtcctagctacttggggagctgaggccagaggatcacttgagcccaggagtttgaagttacagtgaactacaattgtgccactgcacttcagtctgggtgatagagtgagatcctgtctctacaaacaataaaaattaaaataaaacagctagaacagagacttttgaatgttctcactacaaagaattatcaaatacatgaggtaatgcactaagcatcctgatatgatcattatacaacacacacatatatataaaattatacccaataaatatgtacaattaacattgtatcaatttaaaaagcaaactaaaagttaaacataaaacctataaatgtaaaactcctagaagaatacataaggggaaagcttggtcatgaaaattggtcttggcaatgaattttttgacataatatcaaaggatgaggcaacaaaaagcaagaacatacacatggtactacatccgtgtatccaaaatattccaaacatattcaaaacagaacgtggaatagatgtttgcacacccatgtaccctgcagcattactcccaaaagacaatacctggaagcaatcaaaatgtccctttatggatgagcagattaaacaaatgtggcacacatacacaacagaacattactgagccttaaaaatcagagacattttgacaaatattataataaggacaaaccctgaggatattgttaggtgaaataagatagtcaaaaagaaagagacactgtttgattacacttacataaagtatctacagtagccaaactcatagaaacattaggcagaatggtgctcttcaggagctggagagaagcgtggaaaggacaatttgttgtttaatgggtattcactttgacttctgtaaaataaaaatgatctacaaacctcttgtaaaacaatatgactatacttaacactaataaactgtacacttaaaaatgtttgagatgacaattatatgttttcaccattaaaaatttggctacctaaaagagatagttataaaatgtttcaaaaatcaccttcaaagaacaaaagtgttcctctcacataattatatagatccaaacaatagattgtgaatttaagattatttcctaaactacttatctagaaagaataaagcaatcattaacagctaagaaaaaaaatacaagataaatcatgaacaaagtagaggcaatatttatacagatgaatagcacgtagtattttataagcaacaggcatatagctaattcatatataaattaaacattatattgtcttaaagtgtacagagttgaaaatcatcatccaactcataatatcaaggttgaaaaacaaaaatgcaattaactgatctaaggaaacctatctgaaaaaaaagaaacacaatcatatggaatcaataacaagaataagagaaattttagtacataaaataataaatacaacataga

SEQ ID NO: 570 - DNA, 71192 bp, Homo sapiens
agagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttagcatgtttcaaggttcatctatgctatagagtgtaccagtgcttcattacattttatggctgaataataccctattgtgtggatataccgcatttagtttattcatcagttgatcgaaatttagactgtttccacttttttgctattatggatgatgctgctatgaatattcgtatatgaatttttatatggatatatgttttcagttcttctgggcatataccttagaagtgagagtgctcatcatatagtaactctatgtttagccttttgaggaactgccaaactgcttttcaaagtagtagcatcattttatattcccaccagcagtgtatgaggttttttttatttttttgtttttgagacggagtctcactctgtcgcccagggtggagtgcagtggcgttatcttgattcactgtaacctctgccttctgggttcaagccattctcctgcctcagcctccctagtagttgggagtagctgggtttacaggagctcgccaccatgcccaactaatttttgtattgttttttgagacggagtctcgctctgtggcccaggctggagtgcagtggtgcaatctcagctcactgcaagctccgcctcctgggttcatgccattctcctgcctcagcctcccaagtatctgggactacagccgccctccaccacgcccggctaattttttgtatttttagtagagacagggtttcaccgtgttagccaggatggtctctatctcctgacctcgtgatccgcctgccttggcctcccaaagtgctgggattacaggcgtgagccaccgcgcccagccaatttttgtatttttagtaaagacagggtttcaccatgttggccaggctggtctcgaactcctggcctcaggtgatctgactgccttggcttcccaaagtgctggcattacagacattagctactgtgcctggcctcaagtcctttctcattttaaaactgcgttattttattttatttttctgagatggaatctcactctgtcgcccaggttggagtgcagtggtgcaatctcggctcactgcaacctccacctcctgagttcaagcgactctcctgcctcggcctccctagtaactgggattacaggcacccaccatcacgcctggctaatttttgtatttttagtagagacagggtttcgccatgttggccaggctggtcttgaactcctgaactcaggtgatctgcctgcctcggcctcccaaaatgctaggattacaggcgtgagccaccacacccggtgggttgtctttttattgttgagttgtaagcattctttttaatattctggatactagtttcttatcaggtacaatctttgtgaatatattctcccattccatggattgtcttctcactttctggatactatacagtacaagttttaaattttgatgaagttcacttgatttctgttttttatgttattgcttatgcttttggtgtcatacctaaaaaaccattgtctaaatcaattgcctatgaggtgttacccctatgttttcttctaaagttttatgattttagctctttgacccattttgagttatttttgtgtatgcagtgcgagataagcatccagcctcattcttttgcacataaatgttcacttgtcttagcattacttattgaaaatactattttttccctatagaattattttatacttatcacaaatcaactaactataagggtttatttctggactcaattctgttgctctatcttatggtagtaccacactgtcttgattattgtaacttcgtagtaagttttggaatccagaaatgtagtcctctaactttgttgttgttgttgttcttcttttttcttttgtagagatgaggccttgctatgttgcccaggctggtctcaaactcctggcctcaaacaatcctcccacctccacctcccaaagtgctgaggggtgagccactgcaactggcctgttctttttcaaaattgttagggctgtattgggtttacctttccctaaattttcatataactgttaggattcacttgcaaatttatgtaaaaagggcctctggaattttgatagtgattacactgaatgagaggagtttggcaggactggtttcccaagaccacaagaccctgtaagaccctgctgataagacaggatgtggtagaaaggccaacccaaaccagccaaaaccatgatggtgacagaagagacctctggttacctttgctgcccattctatggtaattataatacattagcacgctaaaagaaacttctacagcaccatgatagtttacaactgccatagcaactttcagaagttaccctgtatggtctaaaaggtccagacctccccacttctttcctggaaaactcatgaataagccacctcttgtttagcgtatagtcaagaagcaaccataaatatagccagtcagcagcccatcagggctactcttcctatggggtagccattcttttattcctttactttcttaatgaacttgctttcactttattctgtcagcatgctcttgaattctttcctgaacccacttgacctcttgggctgagccttaaccttggggtacttttgcctataacaaacatacaaagataagtttggctgggcgcagtggctcatgcctgtaatcccaggactttgggaggctgaggatggtggatcgcttgagccaaggaatttgaggccaccttgggcaacacggcaaaaccctgtctctactaaaaatacaaaaattagctgggtatggtagcatgcgcctgtagtaccagctactcggaaggctgaggtgggaggatcacttgagcccgggaggtggaggtttcagtgagctgagattgtgccactgtactccagcctggggaacagagtgagaccctgtctcaaaataaaaataaatttgaggtgtattgccatcttaacggaagttgttactggtggacggtatccaagttactggtggtaaatctgcagcaacctcaattctttcctcctcagaagaaagaatttgactgaggggcataaggcagaaggagggaccgaggcaagtttcagagcaacagtgaaagtttattacgctttaggctgggcacagtggctcatgcctgtaatcccagcattttgggaggctgaggcaggtggattacttgaggtcagtagttcgagaccagcctggccatcatgatgatgaaacctcgtctctactaaaaatagaaaaatcagctgggcatggtggtccatgcctctaatcccagctactcgggaggctgaggcaggcgaatcagttgaacctgggaggcggaggttgcagtgagccaagaaagtttattaagctttagaacagtaaggaaaggaaagaaaagaaggaaagtataacttggaagagggccaagcaggtgacctgagaaaccaggtgcagggcttgccctcttgacttggggttttatatgctggcatacttccgggatcttgtgttacttttccccactcctgagatctttttgagaagctgatgatcagtctcaggtgttttctattgcggggggggggggcgggcgggggagctgcctgtccctggcaccacctgtgaccaattattactttacagaaacatttaacaaccgcctgaccatcacctgatggttgcccaacactcttggtgtgtgtcgggggagccctctcctgccttgctcagacctgaatgtacccattgtaacaaaccccttctttgtatactttgatatggtgacatttcttgtcacttgcctcattgtgaatttttatagatgtggctaagtcatatgcttccttctgaaaaattatgtcaaatactagcagtttctcactgttttttgccctagaaacaacaaactaaccttgaagtgaaaggcctttctgcgtttatcttaccttttttgagcagcattaaaactgttttactcagaccaagtgccgtggctcatgcctgtaatcccagcactttgggaggttgacgtgggaggattgcttgagcccaggagctcgagatcaggctgggcaatgaagtgagagccagtttctacaaaaacatttttaaaaatttgctgggcatggtgggacatgcctttagttccggctactctggaggttgaggtgggaggatcacttgagccctggaggttgaggctgcagtgaactatgatcttgccactgcactccagcctgtgtgacagagcaagaccctgtctcaagaaaatccatataaacatatatagtggtttcttatatacaacattttaaatttattgatatataaaatatgtattttaaatttatatactatacaatctgttatataaaattatttttataatatatttatataatatattttaaatttaaatatatttataaatatatataaatatatattgtacacattactcaatttttctttttctttttttttttttttttgagacagagtttcactcttgttgcccaggctggagtgcaatggcatgatctcggcccactgcaacctccgcctcccaggttcaagagattctcctacctcagcctcctggattacaggcgcccaccaccatgcccggctaatttttttgtattttcagtagagacagggtttcatcatttggccaggctggtctcaaactcctaacctcaggtgatccgcctgcatcagcctcccaaagtgctgggattacaggcatgagccaccacacccagcctacattactcaatttaaccacgtccacctagttccctagacaaactattgctaatttaacttttaggaactactgccatcttgcggaactttgaggttttgccaccccagaatttcctagctgctctgttcttctattatgtggcatagcaaacacaaaatgggtcactttttttctttggagatgggatctttctatgttgcccaggctggtctccaactcctaggctcaagtgatcttcctacctcagcctcctcaatagctggtactataggagacagcaccacactgcccgggcctggttgcattttacttgtctagctatcgtctctttcctgttgactatctggaaatctctgatggggtctttaacagaaaaagtctactccttcagaccttagtttcatgccatataccacatatgacaggtctgggaaggtctggaatgtgtggataaaggcgatggcagtggctgctgccatcatgctggctgcagcagggaggcatggctctgggtgcacactccacggagctggtgggtgccccccaccttctgagttggagcgggagctcctcgggtgctgctgcagctgcccaaacccagccacccagactgcggctgtggatctgagcccccctgtgctcttggaggagggctgggagcaggcaggatctgccttcctgggtgcagagaccagcttggtcacggacaccctaacccagtggtgctagaggaattagacacacatacagaaatatagagtgtggagtgggaaatcagggggctgacagcctttagagctgacagctccgaacagagagttacccacatatttattgacatcaagccagtgataagcattgtttctatagattatagattaattaaaagtatcccttatgggaaacaaagggatgggccgaaacaaagggatgggttctggctagttatctgcagcaggaacatatccttaaggcacatatcactcatgctattgtttgtggtttaggaatgcctttttgcagttttccgccctgggtgggccaggtgttccttgccctcattccggtaaaacaacagccttcagcgtggccatcatggccatcaagaacatgtcacagtgctgcagagattttgtttatggccagttttcgggtcagtttatggccagatttgggggactgttcccaacaccagggtgtggctgcagccaccctcctaggtgcaggacctgggcatctctgcagcctgcaccctgggggccccaggaaggaccccctcccaccccatcccgcaggcttgggggtgtctgctcccgctgcctggcctctcttcactcctggcaccttctccaatcttgaagtggggttggggccaagtcctggggccttgaatggcaatgggaggcagaagggggcaggtccccagtaaggtcctccttcaggccagggagggctgaaggctgggggtggggctgccagtcctgtggattgtagtagggactcatggtgcctcttctgggtgcccgtggacaaattggcagccacttcctcctctctgaggtccataaaagccctgggctcagccagagcagggcagaggatggccagaggacaaagagggcagagaggtggtgggatgaccagctgcagagaggagtactctctgctgatagctggagacaatgggatggctggctgcagagaagagctaccttctccactgagagctgcagagacaacctgccagcagagagaagccaccctttccagggcctcctctccactgagaactgagcactggacagatgacctgcctacagagaggagctacccactgtgggcctcctctgagctgttctagcactaaataaagctcttcttcatcttgttcacccttcacttgtctgtgtacctcattcttcctggacgcaggccagaactcgggcaaaggtgctgcagtcagagaggtttccagccagaaaattgataccccaaagatcccgtaacaaaggtatggagcaaagtgggggtaaggaggtcttggaggttgggggtgtcaaatctagaagacttgctacttcaagaccttctgaggaccctcataggttggggtggaggtttcagtgctctgagctcttctctagccagtatatcccttcctcctcccccatggcttatgccaatcctttaggagtcattactctttttttttggatggagtttcgctcttgttatgcaggctgcagtgcaatggcatgatctcggctcactgcaacctctgcctctcgggttcaagtgattctcctgcctcagcctcctgagtatctgggattacaggcatgtgccaccatgcccggctaattttgtatttttagtagagatggggtttctccatgttggtcaggctggtctcaaactcccgacctcaggtgattcacccacctcggcctcacaaagtgctgagatgacaggtgtgagccaccgtgcccagccaggagtcattaccctttagtctacccagacagagggtggggaacttggaccacagattgtatgtcaaggaaagccaaccactgctaccactaccccctactaatgtggaactaaagcagtagttgacatccacctctacaaaaggccatgaaggttttgattggcccttcacgtgcactcagtagactgcaaccaatcaggaaagagattgtaagacgtgtttattctaccaccatcaacatgccctcagtaactgtgtgtaggaggaagtagaaaatgctgagtacaaatatctgcactgcacgccatctcccctctgtaacctgattcaaatgtttccctggagcagtaggataaaagttacagttttacttcctgggtctttattctacctttaccttccagacctagatcaaatacttcctcctccaaggaatgtctgactgattgtcccttcttaaagcccctgtggcaccaaagtgaagcctcactgtggcatcaccaccccctgcccgcagttacagatgctacacgatgtcatactgagattcgggcaatggtagcccggggatcaagagcaaggggttcggagtcagagagacccacgtttgagccctgaattcttgctcatagctttgggatggtggcaagattccttgcctctctgaatctgggtttcctcatctattgaatgtggataataatgccagctaaggctgggagttgttatgagttcatcagagaagtttagaaatggtagtaccggtcgccatagttactatggaaagcaggtcactttgctttccaattgtgcccaattcagggctttgaattgcctgctaaatatttaatattattgaatcaaagttgaaagagttaatatactttatgaacagagtgagagaaagtgatagtttcaataagttgcctccctaaatggcccaataaatttaatatttataataaaacaactaaatagaagaccaagacttacggcttgtctttcttcctttttaagttattttccagaaaataatatttatattttaagttaaagtaactgcaaattggaaaccacagggggagccccaggctgggacaaataatgactagcctggtcccaacagaacaggcaaagaaggtggtccctacactctttatggtcagttggggccccctcctcactctgctgcagcattctagggtcagggccccaccttccctggaactggggtagtgagtaacccagcctgctgtgctccggcccccctttcccaagaaggttttttttttttttttttttgagagagtctttctctgtcgcccaggctggagtgcaatggcacgattttggctcactgcaacctctgcctcccgggttcaagcgattctccagcctcagcctcctagtagctgggattacaggcatgtgccaccaagcctggcgaattttatgtttttagttgagatgtggtttcaccatgatggccaggctggtcttgaactcctgacctcaagcaatctgcccacctcagcctcccaaagtgctgggattacaggtgtgagccactgtgcctggccaggacttgtctttttcttttctttttttttttgagaaggagtcttgctctgtagcccaggctggagtgtgatggcgtgatatccgctcaccgcaacctccacctcctgccttcaagcgattatcctgcctcaacctcccgagcagctaggattacaggtgtgtgccaccacgcccagctaattttttgtatttgtagtagagacagcgtttcaccatcttggccaagctggtctcgtgatccgcctgcctcagcctcccaaagtgctgggattacaggcgggagccactgcacctggccccaggacttgtctttcttaagcacagaagttctctgaatgatgcctaggacatggaaaggacattttaatacatttgctaatcaaagcatcataaatcttgctttttttccccatagataaaacatctttctaagactctgtacctctttccagagtgctgcacatttgagttagcttaattatagtgtagtgactttgatccaaacttgctggtttaaatcttggctcttccagccgctcactgtgtgaccttgggcaaattaattaacctttctgtgccttagttttcacatgttaaagcagcagtcatagtaatagtatttatcttacagtgttgttgggatggtgaaatgagtaaatatttgtaaatgccctggcacatggtagttgcaatattagtgtgcagtattgtttttatgattagaaataatgtcttcaaagtctcactttcctgctggtttgaatgtgctgtgagaacacatactgtcagttttgcctaccacaaatttgttgagtctcttgcaggtacctccaaatgggcttgtaattcaccatccccacttttcttttttttttcctttctttttctttttatttcttaatttctcccacaaagactgaaagtgaatccccacttttcttttatcttttaaaaattttatttgtgggccgggcacggtggctccatgcctgtaatcccagcactttgggaggccaaggagggtggatcacaagctcaggagttcgagaccagcctggccaacatggtgaaacctcgtctctactaaaaatacaaaaaattagccgggcgtggtggcgcatgcttgtaatcccagctactcgggaggttgaggcaggagaatcacttgaacacaggaggcagaggttgcggtaagtggagatcgctccattgtttatttgcatgtggacataagaaagggttaacatggccgacaactatttcatgagctttttggctttatttgaaaagtgaagtgtgtttggggaaggagttggttaggaaaacagatgcttccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtgccttttatggagataattattgtttctaatgttttgaatattctttcagagatattttattcttatataagcatatgtgtatttgtgtccttccctcattttccccccacaaacactagcagactgttttgcaccttggttagctcatttaacatatcttggagccaggtgcggtggctcatgcctgtaatcccagcactttgggaggccgaggtgggcggatcacctgaggtcgggagttcgagaccagcctgaccaacgtggagaaaccccgtctctactaaaaatacaaaattagccaggcgtggtggcacatgcctgtaatctcagctactagggaggctgaggcaggagaatcgcttgaacctgggaggcggaggttgcggtgagccgagatcgtgccattgcactccagcctgggcaacagaacatatagatctgcttgatccttttcatgactgctacagctccattgaatgtatggatcatcagtgctccagctagcaccttagtgatgggcatttagggatcacaaacttcataagggcagaaacaatatcttacccatcctctgtttctgatatggtttggatgtgtgtccctgcccaaatcacacgtcaaggtaatcccccatgtcagaggtggggcctggtggaggtgattggatcatggggatggatccttcatgaatgggttagcaccatccctttggtgctgttcttgtgatagagctctcatgagatctggttgtttaaatgtgtgtggcacctccccactctcttggtcaagttcctgccatgtaagatgcttgcccttgctttgccttctgccatgaataaaagctctctgaggcttccccagaagcagatgccactatgcttcctgtacagcctgtggaactgtgagccaattaagcctcttttccttatgaattatccagtcttaggtatttctttgtaacagtgtgaggatgagctaatacagtttcctacactgtaacctaaggcaatgctttgcacaaagggatgaaccagattgcttagtaattaaaacacaaatacaaaccacaagcatatccattcatgaattgggggacagcttttatttgattctgagttctgatacctgctgctttgctttgttaaaaatgtgctagttctcattcagcttcctatcagtcatatcaccaaccaacatgtataacatgtacaatctgccaggtcaggaggaaacttatggatacaagaaatgtccctcccttctaggaaatgataatctgctttgggagagaaggcaggtactttttggcaaaagtgacataataaaataatcaaaaaaagatggatctttttttcttttttgagatggagtcacgctctgtcacccaggctggagtgcagtggcgcgatctcggctcactgcaacatccgcctcccaggttcaagcgattctcctgtctcaggctcccgagtagctgggactacaggcacccaccaccacgcccggctaatattttgtatttttagtagagacggggtttcactgtgttagccaggatggtctcgatctcctgaccttgtgatccgcctgcttcggcctcccaaagtgctgggattacaaacatgagccactgcaccaggcgaaaagatggattttttaaaaaaggtgttaggataatcaggtccccacctgcaagaaagtaaagttagaagcccacctcagaccatgcataccagcacaaaaatgtcaaatggcttaaagataaaatgttaaaacaagtctagaaaggtattaaaagaaaatatagaaaatacagcaccagcaaaaatttccctacacaagatgtaaaagccagaagtcataaaggaaaaggttgataaattagaatagataaaaatgtaaaacttttgtataatataagacacaaagaatgaatttaaagacatacaatgaaggttaggaagatgaagatgttttggcgatgagtggtggttacacatcagtattaatgtacttaatgttactgaactgtacacttaaaatgatgaaaatggtaatttttatgttatgtgtatttcatcacataaaaaaagacatgaaatgaatcggggaaaatatttgctacataactaagaatgaaggcccttaataaaatctgtaaaactatacacacttttaggaatgaatcaacaaataatttctatgaattagaaaaaagtgacaatccaactaaaaaatgaataagggatataagcaatgtgtttcacagaaaaaataaaaattgacaatgaagttatgaaaaaatgttcagtctccttagtaattgcacaaaacaaactaaaacaatgagacattacccctaagattagtaaatgttaaagaaaaataataattggtgagggtgtggggaagtgggcacttacacctatgtttggaaatataaattggtgcaaccttatagggagagcaatctcacaacattttccaaagacttacatgcacaaccctatggcagagaaatttattcctcttccaggattttttttccttcaaaaacagtgatgtggatgaaaaacacatgttcactactgcacagggtataacagctgaaaactggaaacgataatactcacattcccttcagtaggggaatggttaaataaattttacaagccatctggtagataccaggcatgagctaaaagttagggtccagttagagatggaaagcacaccagtaatttgaaagggaaaatgtaatatgaagaattattaactagtaaaagaaggctaactgctaaaggtacaagagcactcaagctgtctgcagtcagcaggccccggctggtgagcaggaagctgcccgctgggaggctgccaaagttccctgaaggtgagcaccactggttctacaagctgctggcagtcatggcgttaagagcaggaagagaagcaccagaacccggaagagaaatccagtcctctgctaggccttgcaccgtccctctggcgccctctactgacaaagccagtaaaattgtgccgctagcaaaggagatctttttatgggatgtagcttggtgtcaccaaagagaacagagtggacttggagctcagatgcaacacaatgattgatactggcacagtatacttaccctgcttttgtaaacaaaatggtatatgtgatgtctctctttgtctctctgtatataaaacaatatttgtttctacttattatgtatttatgtctttactctgcatgccaggagctaagtattttgcatgtattaactcattttgttctcataataaccttcacatgcaggaatcattatagctactttatgaatgagccgaggaaggcactgagacgttaagtaacttgcccaaggtcacgcagctagtaagtggcagagcaagaattactatggctttataagcctaggaaaaagtctgaaagaatcaaaatgttaacagcggggacctcaaggaagcattgaagaggccatgggagaagttttcactttgttaaaaaatcagtccttcaaataaataaatacagtgaggcttccccagaagcagatgtcactatgcttcctgtacagcctgtggaactgtgagccagttaaacctcttttctttataaattatccagtcttaggtatttctttataacagtgctaggatgagctgatacagtttcctacactgtaacctaaggcaatgctttgcacaaagggatgagccagattgcttagtaattaaaacgcaaatacaaaccacaagcatatccattcatgaattggggggctgctttgtgtgcatagataaggtatattttttaaaaaaattatttttccaagaagaaaataaaccagttaataaacgacaactcacagtgccaggaagtgagaaacaagtgtgtgataaacggtggagaatgggagcactctccgcagtgggcgggaggagacgaggagggcgttccctggggagtggcagtggttggagcaaaggtttggaggaggtaagtcatgtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagaga

SEQ ID NO: 571 - DNA, 74077 bp, Homo sapiens
cctgcacacattttggtatattctcctggctctcatttttactggtaaaggaagttaaaacaaaaggccaaaaaaaacaaccaatcagcatctatttatttttgaaagttagctccccttaggttccatgcattccacttctttctggatctctggtttcacaggcaagatgggacaggcagagagaacctgggcatgtgccctctgtggagaaagtgacttcagaaaccgctgaggctctattagcctgggattctaaactcggggggacatgaaaaactcaagagacgagtcatcaggctctatattcataagactcttctctgtgtgtgtgtgtgtctcttttcaaacaaatagcactgcgcagcatccttagagactacagccaaatgtccttcatgtattttctctacatttcaagaatctcgggaccatgcttcctatctaatgtgtgaccttgagagttaaaatcaaggggaaaaggtcaccgaattgggggcaagtttgagttcccgtcaccagccacaatctctatatcaaatggaggacaacacaccacctgggcctcagccaggtttgcctgaagcagggccaggcagcctcaaggcctccatggtaggctggggacatggggacgtggggaaagggggtgcagggaaactgggaactaggaggggagcgtgagaaagagggaataaatgcgtacgcggatgaagaggaacagcaggaggagatgaaggcggcgcacagggcagaacggcagacacagggctgggaaggtggcagggccggactccagaacctcagctgagcgttttcttctcctgtgtcccagggatggtgtgaagtgtctacaggcatccgagtgaacccaaagggagagtttggctggcacacggggagacgggccaaggcgcggcgggcgagggcggcacaagcatggcgctgcgacaccactgctgggagcagggctgaaaggtgtcttttgctgtaaggactttcataaggcagtcccaatccaaagactggctttaatttcacggccttagcctctcagtttcttaagccttctgaggacctcctgatcatgacaattaagtcactatttacagccatgtgacagataaatcagtattaggtgatttgttctgaaggacccccaaaaggaaacatatgagagaacccacactcggcacaggaacggcaagagtcctcctgtgagagctgagagatgacattggccctgagtctgtccactgctgaagcttggcagaggcgggggaagcgctcagaacagtcggctgccactgcttagtggaggggagggcgttaacgcgtttccccatcaaaaccaaaacacaacaaaaaacctctctgatttgggaatgtaatcatataatttctacttggcaaaaatgttggttggctatagaacaaaaagaacaatctgaatccaagctattgcctcttaatcctttaattaggctgagtctttcagaagaaagcaccattcattgttattgaagggaaccgagagcaaacggagatagtgacacacacacacacacacagatgcgcacatgcacacacacgtgtgcacacttacatgaatgcatgtatttgtaatgattataattaaactctcttgctgaagggctcagagtttacaaaaaaatttatttgtgtctgagagccacgattgagaacattaaaaaggtcctcctgggaatgtaacttgggggaaatgtggcgagagggcaggactcggcagcccatgggcatgccacaagatgcgcccaggcgctctggggtgaactctgctgtgacttcaggccagaggtgtctgcccccgcagtgccctgacagctgagtggtcggaaggccccggctgggaaggattcatttggaatctttcttcttcttctttttcactagcgtttcttctagtgtagcgtcctctgctatctctactggtttttgcagctttttcttccctctcctctttttgggcttcagggtgaagtcccggccctcaggcggctgcacatggtcccctgcatcctgagcagaggccttggaactctggtcccagcaggggcctctgagctgctcttctgctggcgcgctcttcttcttggccactcgctcctgggcctcggccctctcgggctttccctccgtgtgcctcttggccttaggctggaggtaactttccacatctttacctgtggcctctttatttcttttcttcccccttttacgttccacctgcgtctcagaaatgtcagaccctggaactggaacctggggcttgttcttcagtgctgccatccgcttggcaaagtactcctggatggtgaaggcgctggttgtcgtggtttcgttctcctctggagtggagggactggcatcgccctatggtgggcagaagagttaaaaggcaggtaagcatcaactgttcatccctcaccgcacccaggaggcacccacacccggcgctcacacctggcacccacacccggcgctcacacccggcacccacacccggcacttaggagacaaggctgagtgacacgctccctttggcctctctcccttctggtcggcctgaactgcaggccgggagcaaggcggccacacactccggctgggtaccaggtggggtggtagatgacaggcagaagctaatgtcagaagggagcaggcaagccgcctcgatggaattctgagtaaatgtctccctagaaacaagtgttgtggtgactaagctcccagaatctcccatcagaaacagggacactggtgttccagagcttggtgattttgttagacaccgatttcatcttcattatgggttacatgggcccctgtgttgatctagaaacttagacgccatctggataggttaaccttccatgaggacaggagccgcattccaccctggaacctggcttgccaggggcaccctttctcccccaaaggtggagcgtggccgctctggcagctgctcctgaagggagggcagagtggagactccgcgtgtctcagcctcctccctgaaccaacaggccagcttgggggcttctttccctcagctgggggtggggagtagagaaatgccccctccttccctaacaaaaactgtatactcgggactgtgtttgggctgtttttaaatgtgagttactcacacataacagctgggattaggattttaattttaaatgagtatatctcattgtcaggtaatatctgctataagaaaaaatgtgaaaaatgtatatatctaaaagtacattttgctgtaaagcttgagaagcgagagaaaattcctaaggggagaggctgggataaagaatgaaatgctggaatcgccatttgggctgaggctggcagtaaggtgaggaggagtgcctgtgaggcaggaagtgctttcgggttgaagactataaggaatatgctcggagtcaaatcaatgtctgcagcaactctgcccacagagactctggaaataagtcattaagcaatcatgctaaacttaggttttcatagtcacccaacttcttccttcatactcatttatctcacaagaagaggctgggtgttctacgctttcatgatgggagggtgggaaacggctcctgaataaagaaatctccaaatcaggattctactaatgatcctaaacttggctggcaaggttctgcttgtgcaggtaactgaattacaaaccacctataaacagaccctgtattgtctcgacacagtggtcctcaaaagccacctcagtggaatccaagataatgtcccagttgcagttccagcagaatcgatattaatatgtatcaatggacaattgggccttcagtggcaagtgcctcagacagctttcaccaaggggtacattaaaaaaaaaaatcatgtggtcaattctggaatttcaaaataggcagaacatgaagaataaatcaactgagttttgggaagcagttttaattttatctattactattcaatttgtgctggaattccatagggtgattttgagaaaaataaaaaaaatctgcctcaggagatttgtctttttgttcttcaaatgttgaaaaagagctgaaatgctgcacagcagagtgaaggatcttctcaaggctctcccggcacgagccaatcccaggctcatgaacaagaaagatcctgcctcccaaagacgggcaccctcacagccacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacaaagagacaggctcggtgaccagacaccctcacagccacacagagacaggctcggtgaccaggcaccctcacagccacacagagacagactcggtgacgacggctggctcgtttatgcaacagaagtctcactgacagtttcgcagcactacaggagcctgcagtctgtgggccactcttttggaatgtatttttgaggctggaactcagatctgagtcgaatcctatgactccttaccttgctcatctatttattaccttgtgaattcctgattttaatcaccggaactaattgctggtattaatcacattttttattatcaggaaatacaagaccatttttgagtcacttgttgaattcagcgggtcttcgtaactccagaaagtaagtatgctcatatgctcatcatcaacttctgggatgtaagtttaataggcacgggtcactgcacaggcttggcagggcatggagacaggctagagaggggccagcacccaagtcctacttcttcccagcaaagtgctggccacacaatgactggctagagagagctgcttaatgcgggggtagccaccctcccacatcacagaaacgtgcctattttacaagaccatggactcaaaggaaaaatacattgaaaatctgactcctgcaggagcaatggccaggactcatcttttatacaccaaagtcggagactcagtttcactgcagagattctaatcctgcttctgcattcttgaccatggcatcacataaaaatagatacatcttttcaagaaaactaatgcttttacatctggtctctatcaaagtaaacaagtattgagaaaacaagttacttttaagcattttgaaatgacaataacttgcattttcccacatttccattaaacacacaatacacctcaaaaaataaaataaaaaaaaatttaaatgcgacattcactgcttcataaacgttgagaatgtctgtttgctaactgtgtgccaaaacctaatgaaacaaatttaagagtaacttgaaaacttctggttccatataaaatactaccaagaaatatggttaatcatcttgccaaatgtgatttaagctcagggattcgggaaatgtctctctctctttttcaaattccaatgcttgctgttcagctaaaggaggtttttgccactaatggcaaaaaccgtgattacttttgcaccaacctaataaaataagcaggactggcctagtctgttcacagcaagcctcacagtcctctcccttccttcagcgctaatgagtgcatcacatgtgtcaaaaacatttgatgactgactttcccaaatggtaagtgggccttaatttctacccaatcaataagtacttgtggctttgaactgagatgactctggagcacctgttccccagttcacagagccctgagagtttaaagccaggcccatgggatcaccctgctcaatcatttgaggaagcttcacccaaagtgatcaggcctgggtgtcctgaggaaggcagctatcaccaccgtgccaggcacttgacatcaagtggcatctcagccaactcttgctgcaacctgaggagaggcgtcctctccacatcacacaggcagagagtgagactcctagcacttaatccgcagaaggtctcacagctggaacacagcaggagagagacagccctaaggctgccaggtgcaaagcccttgctccctgtaccacaggaccccgactcctagctcccacctcatggactgccttgtcacctttcctctctcttcagaagccaccccaaaactaaagtatgtatcaattgaccacataatccagagactaaggtctacactcacctaagttgactgatgcagaaaaaatatccacagaaatagtactttcaaaagagaaaaaaactacatcattttggtttgcaattcatataaataaaaaacagcctgaagccaggcttaaaagagttttataatttatcaaactagcatgtacattcacttgaaaaagtttgactgttttaaagcacagagtaaaacccaagtccaaaccttccacccaggcaagaagccctcttgggcagatgctggacagcttccacctggacactgccaatatggaaaggtggctgctgtggttctctgactcagtttcctcatcagcaacaggtcaattcaggtggttcatgggcgtacactgtgtgtcacgattagagctggagaatcttaacgccatctctggcaattccgaattatcactgaggagaaaacaaagagtgggcacaaaggcaagctgaccctgcagagagtccctgcgggtatcaattacaatacaccacagtcctctccggtccctgaaagatgcctgaagctacatgtatcaactcttctcggatgtctacagaattaaagtctgttctgcttcttttaggatcctccatctggagactctgcagctacatgagtgagtatctgcgcaagatcctctgggctcatggaggactttgctcttgtgtcattcaaacatgtatactgagatggattattagtacaatgcccaaatagagaggattctccattattctcaaaagaatcttttggggcaaggaaatgaagcagtttgcacagagaccttagtgaagtgccagaagcagatgcaccttactacagaatccccctacttatgatcaacatgccagtccaggaaatgggcttcaaaggcaagtctttcagctcgccagccttgctcatacatcactactgatcttaagtgacaggatgatggaagctttcttatttccacattaagacacggaggtcatgctgcaacagtaatccttcaatgaactttgttaacaaagtagactcccagagatcaagggtaatgtatttagcaactggggttgtgagccctgatggctattgcctgtgatgaacaaatgctcactgccaccacagcctgtctgtcatcagcctgtgctgggttagtctgtgaaaagttaagaaagcttggcaagtgagtggtttgacagaacattctgtaccttttccaaacttttcagtggggcagttctgacaaacacaaattatgtcttcatgtatcccttcaggtatgaagtgactgtgtgtgactcctcaaaacaaagggattgtggagaccccaccgtcagctgtgtgtgtactttaaactcctccaacagaaggggcaggatgaactgacccagtcactccctatgctggcctacgatgttcttccacatcccctgtacacagtcccgtgcatcactttcttgaagatcaagtgtgtgactgcttccttccacaagtccaatcccaagtgaacatcctttcttgtttattccccataatagcaacttgttgcttctattttctgtatttgtttaatttgctttgctagcatcttcccaaggaaacaagtttcttgaggacaggggccatttatgttgcatttgtattcatacaatccacaacctccctaatgaggaacaaggtacagtaagtgctcaacaaaggcacaaagacaccaaacccagctggaccaaggctgtgaagagctcccaccaccacccactggccccaaatgctttgtgtttgtcagtacgaacttgtctgcacatcaggcaggtctaatgtccagaaggggtgtgggagggtaagaagagaatcagcattttgagtgcagattcctcccatccacatgaaaccacccccttctcatcagatagcaccttcccttgcctcgtgatgcaaactgcttctctaactactgcagagtacatctgagtgtcgtctgctgtcagccagttccttcctggcccttagcaataaatagaaactcagtccagtgatccatccatttctccttctgctctgtcattccacatgttaccacagttgccttggaggggacaagtcaattggaaaaaagcaaggtactgtgtggtatgggaactgccacgttctttttgtgggattagttgaacacaagcaatgccagtagagactgaactgttcttgctaaagaagagaactgttcttggtaaagagaagagagttctcgtgcataccacatacaaaggtaagcagctcatttggagaacagcagtgggatggaagttccaccagcagcctctggtagcaagctgtgaaggcacagcctacattatatcttagctgaaaacaacctgggcaagctgattctagggagtcattgaaatgggtttgccactgaaggctgagctaggcagtgattcacggccgttcgttggaaagcctgccctgagccactatggcgggcggccctgctcttctctctatggaacctctgtggtttcatgcttttccttcgtggtttccatgtaactgaaaacacccagtgttttattgatgaacagctatttttacactcacaaaaagcttttcaagtgtgaaatcttgtacatttttcaagacattcatcgctcacatctggaattaggctaaacgcaccaagtctcggcaatgagcagcctcggggaatttgcctgggagacacaatcagttttagcattagcaagtatcacaagagtcaaaaacaaatataaaaccccattgactgaagagagttgtgatttgaagtggtattaaaaagcaaagatacaataacagaatgagaattatgcagcaactcaattggaaaacacagaaattgtgtgtgcgtgcacatgtgaaacaggtgtaagaacctgtggcatgtattagaagcccactctgcaggggttccagagggttctctctagaacagagactggtgaactatggccgtgggcctagtttttaatgatttttttttttttttaccatttctaaatggttaggaggaaacaaaaaactattttatgacatgtaaaaattacatgaatttcaaataccagtgtccttaaagttttgaatttcctcagtaaaaatcttgtaaaaatttgttttctttctcattatacaagtacatacaataggtgctaagtaaatatttactgaataaatgtattataaaatcggctctgtgactgtgaatacaatacggctgacttttggaagtggcaggtgcttttccagtgcacacacacaatatacctttatatacacacatgtacatatatacacgtatggaactggaggacgctgggctttgacaaagtcctcaagctctgtctcctgccaacgacagaatgcctacctttctgaactgtgtcagcaagcagcagagaggctgctaactgctgcctgcttttgagtagcaaaagccagtaaagaaaaaatttgtttaaaaagtgatgtgacatcaaagagcactctcagcaacccagtaagtatgcagagatacctttctaatatcaggcatcagaactccgcttggaagttacaaactcagacacaccggacattggagaagataatacgaactagaagggacagaatagcttggctggactttagtagagaaatacacagaatgccaaattcctcatatgaaggccaatggtaacagagctgttaattttatgtctttttatttttattttttcccatatgcctaaccagctattccgattgccacttattaggaaaagccgacataaacatgttttaaaaggatggttctctatggcaacagcttctcaagtaatcaacatcaggatcactgacaagagtcatccagcctctgtggaaaaagaggaaagagaaagaggagcaggcttcctgcctccctgaaaggccctcaggctcggaaagctgcagtgacaaactttcccgacacactggccatggaagataaacgaggctcctccagagctggagatgatcaatgtgacacaggcctcaacttctgtgaatgatgtctaaaaataatccaaattgactgcattttataattccaggtcaaatcgttctctcccctgctctccagaggcaggacaaacagctttgataaacagctgagacccagcactggcctctcacagaacagagcagaagcttccagagggttctgtctcttccatctttattccacaggaagaggtgaaaattgctgaagaaccatgacaactcaaatgtaggctccttactatagaaagcacagcagttcttgaagattctattaaatgtaaaatcttctaatttctaaaaagaataaggtcttttttttttttttgagacggagtttcactcttgttgcccaggctggaatgcaatggcacaatctcggctcaccgcaacctccgcctccagggttcaagtgattctcctgcctcagcctcccgagtagctgggattacaggcatgtgccaccacgcccagctaattttgtatttttagtagagacagggtttctccatgttggtcaggctggtctcgaactcccgacctcaggtgatccacccgcctcggccacccaaagtgctgggattacaggcgtgagccaccgtgcccagccgaataaggtctttttagagaataaaatattcattttgaaactaggaatagggtatgcatagttacatggaataattaagtagtcatgattgtttataaaagaaaggtaaattaggtgaatatagttgactaacaaaaaaagtctcgtctttcaattcttataaactacataaggctaatattttcacatactctttctttcaccagaaatcaatgtagcaaataaaaatatttgagaaatatttttaggagtaaatttggcaaagcaaagtcattctatgtttaaaagataccgaaattagtaagaataaataaaattccgaaattagtcatgttaaaagagtaaatgatataaaataatacatcagacagtgttcttatcacaataaaaaaaaggcaatataccggcacaacttatttttagcatagacaaaaactaaacaacaacaaaccaactacaaagccaattctactcaagaaaaaccctaaccagttacactgagactgtaattccaaggagctcataaaaaataaaaattgttactgctattaaatatataatcctataacctcttctcttgttttacacaagctgtaagtttttattttataaacaaaaaatatattgaaaacttaagtgaaaaagtacaagaaagactgtctccctgcatgttcagaatccaaaaaggttcttgaagcaagacctgcctcgctggcaacaaagcattgtttgcagttctgaacccacccaaccaccagaaattcaatgccctccagcatgctgcttctcaaactatcaggggtaaaggattagttctgtctgttttgtggttttttttttttttttttttttttttttttgcctttaaaaattttgaatccattacaggattacagggcaagatttttataaagttaaaaaagttagcagaaaaatgaagttttaaaaaagacatctaaaacccaagtcctaaaatattgtcaaactactagaaaagcttctaaatgcttactcttaatttctgtctttatcttgtctatggaccataatttgagtggcactgctataaaatatcagctagcaaaggacagaaaacgggtactcaatttaagatagtataagtggcaatgacctggctgtcagaagattggaagcacaactgacagaacatgtgatctaggacaagtcaccggcctttccaggcctcaaatgcaatcatttgcaagacagggaaatagggctcctcagtaacttttttcaacatagttttttcacatgactttcttcaaacacaatcttaaacagaaggccaatctgtacaacatctcaggaagctttggctgcagcggggtgggggcaacccaaagctcatgtcccaaccctcccctcaaatccccttgtaaaagcccctggggatgctagaactctatggaatccactttgaaaatcaacagctacatttttaaggtccatcacaattctagcattcattatagcctagataagtccatagcactcagtaaaaggagaaggcaaaagctttcgagaataaaattggtcttgggctgggggcgctggctcacacctgtaaacccagcactttgggaggccgaggcaggtggatcacctaagatcaggagttcgagaccagcctggccaacatggcaaaaccgcatctctactaaaaatacaaaaattagccgggtgtggtggtgcagcctgtaatcccagctacttgggaggctgagacaggagaatctcctgaacctgagaagcggaggttgcagtgagccgaagtcgtgccactgcactccggcctgggtaacagagtgagactccgctcaataaataaataaataaataaataaacaaacaaacaaacaaacaaataaaaattggtctttaacattatataatatatataattcttaacactgtcattaacctttggaatgtcagcaattggctgtcagaattgtacagccaaccaatttcttccaaaaatggtaacacagaatcaaaactgaactcccgcctcaagctgctaactgggtcctcttgaggctcacaacggctgatgatgacctcaggctgcccactcttccagctctgcgtcgtaaggtcaggaagggaccacgaggaaggggaagcaagggatgggatggtgctgcccagacctgtcaccagagtcgccaccctgctcccttcagactacggctggagacgctggagacgcagagctttgccttctccgccaacccttcccccacactgcaacccaaagaaaggtcccccttcttcctgttttcatgatgtcacagaaggaaaatctggggaggaatgttatttctgctttcctggcaagagagaaggacagaaggaaaaataagccagtgttttcctcctcttctcctgcactagaccatatgtatgtcagtttcttactatcacaaaagctcttaaaaccacttgcttcatctgtcaacaaacaaaaagccaaatctaatcctttcaggccgaacgtgtcctggtgaagctctaaccaaacaaaacagcccagcaacttccaacccttgggtgtgttggcaggccctgccctcaccctcactgctttctcatttcttctttatgagtgtcttattatgaagttatgtttgctgatctacaagacgacataaatttttactggtactaaaacaactctcaaaaagtcaggacccactttctcctttctggctcctctagaaagcagaggcaggcccaagccccgtttgaagtccttgctgccgggagatggccagtttatgtctcttgtcctaggacaggaaaaggatgcactctcggcaccatgtgctagagcgagataagaccagagattctgtcctcggcaccttatcagcttttcctgccactttccagagcagacagcaccatggctggcaatgaacgaagctagttgaaggggggttgggtgtgcgagtggcttggggactgcagggagtgaggtaggcagggtgtagaatgagaaaaggaaagagaagaggttcttcgtgtatcttaaaatggtttggtccccccaaaattgccttttttttaaaaaacacatggattttgcatctctgttggaactggagcaactaggagagatgtttttataaggacttccgttctggttagaatgaaccaccactttcattgcttcgcactctgcccgtcactgccttgtgcgactggctcctgggcacgtagcacaggatggatctgctatcagatactccgtggaaagactgcggggtccaggttgcagagcgggtgccttccacaggcacgcaagcctctatctgcacacccagcaatctcctggggccaggacacacttgctcacacgggataatccgcctcacagtgcaaaggaacaagggaggctatgggacactcctccaaatacagacgaatggcatcgatgagctgctttgttctccaacaaataacatctgtgaatccaaggattacactctttagaaaccctggtctttgggggctgggttagggagggggtgaatataactcttggaaaaaaacctagactaagcagggaaattttaacttagttatggactcagttattgataatgaactcatgaaagttcaggttgagtatcccttatttgaaatgcttaggaccagaagagtttccgatttttgatttagggatattcaacctggaatatcaatataaatatgctaaattgatattccaggttgaacatccctctcgtttttgcaaattgttgtcgatgaaaccaaatcatttgtcctgtaaagttctctcataatcagatttttgctgaatgtatccccgtggcataggttaacacatttctctgtctcatgtatctcctgtagggttcaagtgagaggcagccttactttctaacggagcacttttccaatgccagcatgttgttttatgaaaaactgggctggattcatggtctaagtaagtttgggaaacaaacctgtgctattcctccctttgattcacaatgcatatcaccatctgagacacgtggccgctgttaaacttcagaatggcccacatttatttgatcctggaaccctttttggtaaacacccactggcatcccatgaaattagtgctctgctgaacttactttgaaagggctatttaaacagatagttccattatctggataaaatgagtagttctcttgttaaatctcatagttaaatctttgttttgtcccagattgtccaagagggtgggcttttacccatgtaagtttttgcaaaaatgacaaaagcatagcagggaagtgaaaagagggcctggcaagcatcccactatggacgctagcttgcagagcgcctctgggaggagaggttagctctttcccagctatcacatgattgaaatgggaatgtctgttcctaggtttagaaaaattacgcttccattttggaatggagggtagcggagaaataacatatcctaaatgatgccaagtatggatgtattttctttgtttacttttaagactgcctacaatctagccgtattttttaaaggattatgtgtaagcagcaagccctgcagagtctgacagtgagatgaccactgtgaagaaagatcctgggcgtcaggttccacttaaaggccgtgcaaagttcaaaccacagaaccaagaataaatgtataaaataacgaagtgaataaaatatggaacacagaagtcaatggacatataacaaaatcaaattcaaaaaagcaatttctaaaagtgaaatgaaacaaacttgattctgcaactagctggtgaagagccacacaaaaagaaattccagatgactgaaaacataataatttaactgtatagactgaatgggaaatacataaagacaaaaagaactgccacacacccaaaacaaaccctctgaatctctctctctctttttttaaaatgatcaagttattggcattactctgtaactattgtgtgtataatgggaaataagcaaatgagtactgtgatattttaatgcttttatttctggaacctgttgattccaggaaacttactgtcgggaagtaaagataaaagatgagtggggttaagtacttgtggtcctaaatctaatctggcaatatgactataaactcaggatatattttatcataaagaaattatagttttatacatgtaacaaggcctacaaatgaagaccaatctaggaagaaatgaacaaccccaacgcctagactgtgtcgctaaatatcacttaccacaaagaaaggaatcagggagaaagggacgactccaagtgtggggcagaaaatgtacacagtggacctggaaactcttacactagattggaaggaagctattaaataccacttagggtcatctcaacagtactcaggtcattatctgtgtatagagataccagagatttttgtatgttgatcatgtatcctgcaactttactgcattcatttagttctaacagttttctggtagtctttggggttttctacatataggatcaggtcatctgcaaacgagataattttaatttttcctttccaattcagagatcttttatttctttttctcatctgactgctcttaatagtacttccagtactatgttgaacagaaatggcaagaatggacatccctgtcttgtaccagatcttagagggaaagctttcacacttccccccatcagttatgacactaactatgggtttttcataagtggcctttattttgttgagaaattttctttctgtacctaaattgttgagagtttttaccaataaaggatgctgaatgctttttctgtgttgactgagatgatcacgtggttttgtctttccatctgttaatataatgcattacattgactgacttacacagttaaaccagccttgcacgccaaggataaatcccaaacaaatgaaaacctagctgaaaaagaaaccaagaaaacaatcccatttatggtaccatcaaaaaaaaaaaatcaaaatacttagggataaatttaacataggaggtaaaagacctgtacactgaaaactataaaacactgatgaacgaaaaaggacacagatagatggaaagatattccatgcttatgaattaaaagaatattattaaaatgtccacatgacccaaagcaatatacagattcaatgtaatctgccaaaatcccaacggcattcttaatagaaatagaaaaaacaattctaaaatccacatggaaccacaaaagacctcgaataactgaagtaattctgagagagaaaaacaaagctggagacaccacacttcttgatgtaaaattatattacaagctatagtaattaaaacagtatggtactggcacaaaaaacagacacacagaccaatggaacaggttagagaactgaaataaatctaaacatttatagtcaactaatttttgacaagagcatgaagaagacacaatggggaaaggatagtctctttaataaatggtgctggaaaaactgggtttctcatgtaaaaaaatgaaattggaccttatcttacaacatatacaaaaatcaactcaaaatggattaaagacctaaacataagacctaaaaccattaaactcccagaagaaaacacaggagaaaagttccttgacactgcttttggcaataatgtggatatcacaccaaaagctcaggctaccaaagcaaaaatatgtaaacaggactacatcaaactaaaaagcttctgcacagcagaggaaacaatcaacacaatgaaaaggcaacctacaaattagggaaaaatacttgtagaccatgtatctgatataaagttaatatctgaaacttaaaaagaactcaagcaactcagtagcaagaaaatacataacctgattaaaaaatgggcaaagatgctggacaggtatttctcaaaagatgacatacacatgaccaaaagatgctcaacatcactaaccatcaaggaaatgtaaatcagaaccatcatgagatatcatcccacacccattaggagagttattatcaaaaagataagagataataagtgttggcaagagtgtggagaaacaggaaccctgtacactgctgatgggaatgcagattggcataccctcaaagaaaaacagtgtggaggttcccaaaggaattaaaaatacaattactgtatagcccagcaacccctcttctggaaatatacccaaagcaaatcaaatcaccttgtgaagatgcctgcagtcccatgttcaccgcagcagtttgcataatagccaagacatggaaacatcctaagtgtctgtccacaggtgaatggataaagaaactgtggtgtgtatgtatgtatacagtggaatattactcagcctttaaaaaggaggagatccagccatttgccacgacatggatgaacctagatgacactatggtaagtgaaataaaccagacaggaaagaaaaacattgcatgatctcactgataagatggaatagaaatagagagtaagataaaatgtggttactggagcagggtgggggatagaaatggggagatgtaggtcaaaggatgcaaagtagcaggtgtgtaggtccccacactgtaccttagctctctgcacttcagatctaaggtatggtgtggggactgtggctaataacagtgtactgtgtcaggaggttcactaaatgagattacacctgctcttgccatgaagggaaaatgggtaactatgtcactacatatatgtaactcataacatgtacagctttaaatatactcgataaaaaaaaaaatttttttttttaagtactcagaggccaggcgcagtggctcacgcctgtaatcctagcactttgggaggccaaggcaggcggatcatctgaggtcgggagttcaagaccaacgtggccaatatgctgaaaccccgtctctactaaaaatacaaaaattagctgggcgtggtggctcacgcctgtaatcccagccactcaggaggctgaggcagcaggatcacttgaatccaggaggcggaggttgcagtgagccgagatggtgccactacccttcaacctgggcaacaaagtgagatctgtccagataaaaaaaagtactcaggagccagactcccactgggtagaaatggaaaatttgatcaccaataaagataatagctgcaatgcattgaaacgtcaaacatttcaattcacgaacaataaaaaaaggaaaaccctccagtcatctttggagaatgctagagcacctcctcatttggaaattgctaaataaaggatataaatatttattctgtctttcctatatgcactgttcctcagagtaatctactaataaggggaaacacacattccaaatttcattctaaaaatgaaagaggaacagaaagaaatatggagggagactccatagattgcaagaaatttaaaagatatatcaaccaattgttacgtgtgacccttatttgaatcttaattccatgaaaatgtaaagaaaactgaaatttatgacatttatgaacattgagctttgaacacttattaatagtatgcaattactataaatttttatagagtataatggcactggagttatacattttaaaaaagaacctcttaacctttagagataaatactcaagtactaaaatacctgtggatgaaatagtgatttctgggatggatttgtttcaaagtaacacagaaaggagaagtgtctggagcacttacagactagccatcagtgtgtttgttgttccccaaaaggacctgtgctttcaagaacccgtgtctttgcagatatggtctttttttctctctggaaagcctctgaacctgccagttgctgctccttcaagacacatacaaaggttatcttccttgatctctgcaagctgaatccagcgctgcatcacatatgcccccagtcctctggcacagcactcaaggcctttgctccagttgactgtgaatgtcccagacttcctgatgaggttgtgaacagggattataccttacccatttaatcatctgtcatgcaataatgctactgggtagcaagaaaaacatctgagttaagtaggaaaaggaattggaggggagagggaaacaggaagaaaatgattaaagtactattactcagaactatgaaataatgagatattaccctgaagggagtcattctaagactatagccttgtgtaaagacactgagtcaattcaagcctgatcctaacattttaagacacagatgactagaaagtaggctctgtttatgaatcacttgtaacttcaactcaaagacagctgattttattcactaatgttaagaaggtgcctccacagtatgagcctaacagtggttaaagccttgtaagaatccctataaagagtctaaactaaactctgaccaatgatgataatgtgtcatgcatcatgattaatccaatttagagtatctgaggtccattaaaaaacaaaataatgtgaaagtcatgcttctgcctgtataataacacacagatctccatagcagggaggacacaggggatgagagtgaggaggctgatctaaaacgaaatgactgatttaactaaatgaataatatcactgttttactttagaaagcacatcacacattttagaagacttataagtggctctccttaggatcacaaagtaagcaggcacacaaatccaatctaaaacttttaacaatttgggaatcggaattcgatacattattttaaagctgatactctacttacaagtttcagcgctacctagaaataaaagaaaactaactgcactgattcccaaagtctactcaacaatttcctataaaagctatgttccttttagaaagggtgctgacatgaaatgttcagatttacttaggcaaagtagctttcctaagttagcttttctgcttgcagaaaaataaacctcacaaaacctagtttactgaaaggcataaagtaagtttaagcacttgttaaaaagctatttggagttcaggcccacaaaatgcttcaaaaccagtcaggtaaaatttaaaacctccatgtgattttaagagtcagaacgtgaattaaaggagcctggactaaagttaggggacagaggtgactgaaggggggatgtcattaatgctagtactttgcttaaagcaagcctttttgatgcagaaaagataaacttgtcaaagaacaacagatgacaaatcaaagactaaagcatttcagcctcgtgctctttggcagagactgcccgctgttcgaagacatgcaaactctgagtgaacttcctagaggctcaggtggcttcagaaaagaattaacagaaccttcagaaacagaaaaacctaccagcactctgatccctaataaacataaagagcgtatcatttaaatcttaccaaggaaaaaaacttctttttagaaaattcccataacgttttaagctagttcaagattgtgttttaaacagaaatttctggttgttacaaagtagttccaatggaattatataagattacaatttaaagacagataagcatcaagagatattctaaactacacttacagctattaaggaaatcctactaacttcaagctaagtttaagctgcttcttgcattattctatggaaggattggcgtagcaagttaacccatcagaatcttattttaatactttactttagaaccagtctacgaaaagataagattcttagactccatccaatcatgcttcggtgataaattatccaaatgacttaattataaacagtttgaattacaaagaactcctaaggcacaggaaaatgtttatttaaattactataaaaaacactttcaggtagcttcaagcaataggatagcactcacttatacaaacatttgttgtactaattacaattagttcttattatagcaatcccactgggacagtttgaacaataagctggggttgaagctgttttttcctctagaacaaaagttctcaaaccccaaactcaaataagaaagatcttaaatacaaatgcttttcacaacactgaactaacttgtgtggaaagaccgatttttaagtacccagtatgtggaggtctgttgcttgtgtatgtataccaacatatacgtgtgtacaggaccccactccatgtaaggaacaaacactacatactctaatggaacacaaatagtgtactgagaatagttcttttctctttagctagacaagtgtttaggtttgttaccctgaaaatcaaattaaagatggaaggattagctacctgaaaagattctggactgcgtatatcactaccagattaagggagtttatgtggcgagcgcagagctagaccacggtgagtaaaagggaggcagtcactttcctcactgaggacatccaggttgtatgtggatccactagtgcctttggtttataatccttcatttttcacattttcatcgattcaaaatgccttgttatcttaaaaaattattcttaatcatttgttcacttccttgccaatatatttaaagagacgttacattttaggtgaatttcttgggactgacaaacctgataattgaacatcagagttaggtctataaacggcatcaataccttcctgaagccaatacaaaagtgaagaggccttcctattctcttgcatggttggctctttctacaacaccaagtagcgtggctgtcttggtaaacaggggaatggtgccagtaaaagtggggagttgcacggttcaaacgtgacatttcctaagcaaggggagccaagacagtgtgagcagaactataaccctgagaaagaaagaaaaagtcccaagtctcagcgtggctgcagcataggcaggacccctccagcctactttaggaaaattaagcgtgagctacgccccagaagggctcaccccacagggttggaccctgtgactggtcaatgcaggggcacaaagactctgccccctccaaagatctggggcagttgggaagagctccctgtggagtcagctgaaaacttcagtgtatactgcaggccaaatcctctccctgtgtaatcttgcttcctccctcttgctcccccagaaagcagtcctgaaagcactcctaggaactttctgcaggccaactcccaggaaccaacctgcaaactgcacttgcacccagcgcctctccccagacagccctcagctagtggcagattgcaccccactgtggacccctaatggggagcatgtctattcgactgtctttgaacatttttaagactcccaagtagccccccgatctcagtgaattatctcatgagggaacaattactgtgtgtgtggaggggtaggcaacaagtattctggttgtaaaacgacatacattttaacagtttgactcttacccaatttttcccatgagctctgttatttttatatttttgtaaaatatttttcatgaatgcataaatagcagaaatgtctatatttgatatattatatatataaatgtatttacatatatatacacacatacacatattttatgcacacacacacacacgtttgtttgttttttttccaagagacagagtcttgctttatcaccaggctggagagcagtggcgcaaacacagctcactgtagcctcgaattcctgggctcaagcaatcctcccaccacagccccccaaggagctgggactataagtgcatggaccaccacactcagctaatttttaaattttttgtagaaatgggatcttgctaggttgcccgggctggtctccaactcctgggctcaagcaatcccgcttcagcctcccaaagtgctgggattacaggcgtgagctaccatgcttggctgacatatcttctatttgacattagtattttgaaagagtttacaatattattatctttcagattacactgtaagctatgtgatggcaagaaccatttaccttttggtaaaaagccacacaagggaaattaaggataaatgtggattcagcagggatggtaatctatgtggttaaagtgagtcagtgtacggtctctttacgaagtgaatacattaaagcccactgggaaggtgaaatcaacaaaattcaggacatgggaaattctgtaagacaaggaatccaaggtgacttcaacaataaactgcaaagaaaaaagagagaaggaatgagaacctattggttaagaaagtctgaaagacattatcaattaatctataatatacagaccttgttagattcaaatacatattcaaagtaaaaagttattagacaactggggaaacttgaacattgactggatttgatgatactgagaaactgtggttaatgttttttggtgtgataacagtactgtgactgtgtgttatggagtccttatcttttagatatataatacatacagataggatgatgtgatgtgtaggaattgcttcagtaatgggaaagaggggtgggagtacagctggaatgaggctggccacgaattgatcattgttaagctgggtactgggcacagacagactcctttattattctctctacttttatacacatgtaaagttctccataagcaacagttttaaaaagtgaatgtaggctagacacagtggctcacatctgtaatcccagcactctgggaggccaaggcaggcagatcacatgaggccaggagttggagaccagcagttgaagacatggtgaaactttgtctctattaaaaatacaaaaaaatcagctgggcatggtggcatgtgcctgcaatcccagctgctcaggaggctgaggcaagagaatcgcttgaaaccgggaggtggagggtgcagtgagccaagatcgtgccactgcactctaccttggaagacagagcaagacactgtctcaaaaaaaaaacaggaaaaaaaagtgaatgtatatctattggtataatatcattagagttcttcctggagtacagtaagtaacctaaggcatctgtgtctaagtgaaagtggtcacagaaagtggcctacctgaagcctggcagttccattatcctaggagaaatcatcgtggactcttgcagaaaaacaaggctgagaggaagccaaccaaggcagaaaggtgaccccatctgtgcgctgactcagacagcaaagcggtgggtttcccttatgagatcatggattggccgccagagaccgctactaatgttagaacagggtttttccctgaaagagtcacaattcctctccctggcaaaacaggaactggtcctaacaggaatattatgtaataccagaactgaggagctcaggaaaagcaggatgagggtgggggtggggattgaagagcagagccctttgtgggagcgtgaaagggacaagcccagtaccggcttcctgccagcctccccttccctcctgctgcagcgccttccctcacgggatgagcaggcatctcataggcagacagaacatggagcaggaataaaagactcccaccttctccaaggctgacggtaactgaccatgtaactacagtgtaactgaggggaccctgcatagacagaagatgggccagcgagatgaggagccatgctggacgagcatcctttttttccagatgtaataaggtataagtgacagaggaagactctatgtttaaggtgtgccatgtgatgttttgacctacatatacatagcaaaatgatccccacagtcaagctaattaacacatgcatcacttctcacagttacctttgggagtgatgaggacacctaagatctaatctattagcaaatttcgagtacacagtgtgttcttattaactgtggtcaacatactgtatgctaggtctccagaacttactcatcttagcctctgtccagaggggagctcccttgcaatgtagacagggcagtggtcagaggagtagcattttaggaatgtcctcaaatagcacagggaccataaacaacacatgtcacaggcccagtggcagagccaaaaacgcaagctgctaaagagacaaaacgtgttcaattgtttttcaagttcagtattgtccgtatccgatgaccctgcttttgagacagacaggaagggtacacaccactgagaccacacacacacacctccacgtgcccagcttttcactgtggttatctctggctgtttggatcatggatttttcccccttcttcctaatgtactatgtacaggtcatggtttctctagagtggacaggtactgcttttataatttaaaaatatttgaaattaaaaactcacaccgaaaaaaccctacaagcctagggcagagtgctctctctgtgaggacaactgcattcaggaggccaggatgctgtcacagccaagcggcaggtcctgaccctcatctcgacaagacacaggtggaggcgccgtctgcactcactctcaggactcaggttccctcctcatccctttcccttccagaaggtccccatgcttctctcaaggttcctccccaactacaccccaccggcttgtgtctgtaagcgatctaacggggctgaataaaaaagtcttccagcacagcaaatgacagaaaaagtgttcaaatgagaacaaaagaggcttttcaggaagtcacaactcgatggcagagaaggctctgacatgcactgatgagtacatgaaagaagtgaaggacctcacagcatcaggtcagatgtggaggaaaagttaacagcacgagcgatgagatgacaggcaagccagggggaggaagcaagggtgagccagcagaggcttcacatccagagctgctcccatctgcacgtctgccctgccgtgcgctcctctcccaggagccgtgtcaccatccatccaagctgtcggagcctcaactggtccatactgtcagcccccaatcccagggcctcgacctcccaacatgactccaccaagctgcccctttctctttgggtcttgccaccactgagcagctcaggctgaggctcaggctcgggctctggcatcctctggaacagcgacctctacctgcctgcctcagtctggcccctccttgccctcttcattcttagtgctttatctctgctgctaaagggatctttctaaaatgcaaaagcaaccagccccgtcccatacttcaaagccccagaagctctcaagtacacgcaaaacaaacagtctatactccctgcagatgtctaatgggggctctcagggaaaaaaaaatccccctccctcccccagtttttattgagacagagtatcccaccgttgcctcggctggagtacaaaggcgcaatcttggctcactgcagcctccgcttcccaagttcatgtgattctcctgcctcagcctcccgagtaactgggattacaagtgcgcaccaccacacctggctaattttttgtatttttagtagagatggggtttcactatgttggccagtctggtcttgaattcctgacctcgtgatctgcctgcctcagccttccaaagtgctgggatgacaggcatgagccatcatgcccagccaaaatcccccctttttagatcctcagcttatttttcaacacccaccagaaaagtcaaaattaattcataacaagactctgtttttcaacatccagctgcagctaaagcatctgaagcctctagtgactcccgtccctcctcggtggaagcacacatcgcaaatgctcagtacacagcatccttgggtcactgcaggcacagtatgaagtgaccagcttagggatggcagctgctccaggctcctggccgtgacgagggctgaggggatcaacccctcggaccaccaacaatccacttgtggcatgccagctggtaaactccaactgagaataaaggggactgttgaaacctgcttgtgaagctacaattagaatttaggcttcagtgcaaagttggaaacatagctatattcttttaaaaggactggtgggttattttggtttggggagctccagcccccatctttgtggcggctgctgatgtgcttgggcgatctgctggccccctggctttctagagagagtctgactacaaactataaaccctggaagagacgccagggtggtggcggcaacctctctccagcactgcgcgaggcaaaggacttgcatttggcctgtggtgctgccgcggttcctgcctgggagcggggagacatcctgccctcttccaggttgacaagaagcgtgcagcttttgaaggccctgagacccccaggacaacatgccccatctcagtctctccacagaggtgccagttacacctggcagtgatgagactcttaactctccgtgctggccaggaccgccccctctctcccgctcaggaccagcaagggtagcgctggagcttgtctgtattacgatcagctattggagtctgagtctctggataaaggtccagctatttagagacctagagaattatcctctcattggatgacagcaggccccgcagatgcgctggcctcgctctccctgcactctccgcgctggatgggcctgcagctgcaggttcctctctgccctctttccacttcacgtccgcacccactgctacttctgcttgaaaatcctcctgcatcttctcttactgacccttttgtcctttatggactagcaaggacaacacctcctccaggagggcaggaacccacctgagagggagatgccccgggggccacgtgcacaccttgcctccagctcaacagttaaccaaaccgcatcaaaatcattgaccgtccctcccccgtgacgctgtgcgctccctgaagggacagactgtgcctcttcttcacagtccatggttaagagcgcctggcacccgccatcactcaggagtggttctgggagaaacagatgaagtaaagcagtttacaacaaacagaaatactctcaggaatggaattcatgaaaggcttgcagatggtacaccacatacacgccgccggtactctggcaaaggtatttttagcatcttgagattaaatggttgtatctataggtgactgtaataggaaaaaaagaactacttcagggacacgattaattgctgtgatgtgataaacagcagtctacattgtattcctcatggcatagctgtcacctgtgtgaattacttagctcataatgtttactatgttagttagtgtgagtatacacaatacaccatctcattatctgagatgcccccttacctctcccagtcaagcagctttcatttccaggtggaagctgaccgcacactgcacctcagcccttgtccagactgtcttgttgccacttccatggatttgctagatcctgctccaaatgaacgtgtttcccggcgtgccattctgaccctcgctaacatctactgagtgcctactatgcgcgaacactctgctaggggtagatacacatgatgacgaaagcatgatcttccgcttgaggtgcttcaagaagtgtaagcttgaagagctcctgcccccaagtctgtaactcctagtgtctgcatcctctaaactattttaacaagcatattatctacataatgctcaattaactggtctacaaaccaaattattattgacaagttcttctgagccaagagttatgctcctgagcttagtttgcccaaatgttttcacctagaccaggggtgtccaatcttttggcttcccagggccacgctggaagaagaagaattgtcttgggccatccataaaatgcactaacactaatgacagctgatgtgctatttaaaaaaaattgcaaaaatatctcacaacatttaaaagactttacgaatttgtgttgggccacattcaaagccgccctgggcagcatgcagcccacccgccatgggctggacaagcttgacctagaccattacctttctaccaaaaagcttctaaggaattaatgctaaagaaaggacacagacgtccgctggaacgggggcatttgttttaattttaattattaaaggtcattaatttcaatagccagaaaaaaaaaaagaccttacttgaaaaacaaaagtatagtgaatttacaaaccattttgcctcagggatctctgtcaaagcagcaacatgaatacacttaatgctgttgtaacaaatcatgacaacatgagtcactgaggagcctcttagtatattccttatgacctgtacagatttaactcaagataaacttcaaacaaatattgcaatgagtatctagtaacagattcaaagaggcgacaaaataattccactggggtgtgtaaaagctacgctgctcaacatagcatttgtgtgagaagataactacattcaaagatcaggaatgtttttaaatttgaacaaatgtaaactgttttaaaaaatggacttgctagttgctaagcaggtgtcgtcaccagaataactctcttcattaatttttctcttcaaaagtgagaacgttatgaagtggcagtgaaggggtatttttagaaatgggctcagatgaaccaaaatattaatgctcaatcactggtaatctatcacgattaaaattttaaattacaattttttaaaaataaaattttaaattacatttaaaacatacagatcttaaaatttcaaatatttccgttaacctacacagaaaagtaacttttgtttattcacaaaaagtagcttcatcatatattgacttaaaatatccgaacagtattacaaagtaaaaaggagcaaacccttcgcctgttgctaccttttttttttttgagacggagtttcgctcttcttgcccaggctggagtgcactagcgcaatctcagctcactgcaacacctccgccttctggtttcaagtgattctcctgccaagtagctgggattacaggcgcctgccaccacgtctggctaatttttgtatttttagtagagacggggtttcaccatgttgaccaggctgatctcgaactcctgaccttgtgatccgtccgatcacgaggcttcccaaagtgctgggattacgggcatgagccactgcgctcagctgctgttactacttttaaatgagtgggaagatgcgttcaaattagacttttacgggtttaaaactaaaatccgagtgcatgtatgtttttaagattccattttgtttttagtgacatcaatataacaagtgctctgaattcctcccaggaacagaaagaccatttatctactgtatttattcagggcaagcttcccatctgtgtcagactgagagatttaacattgctgaagaatgcaggtggtgataaaggagggtgacgctagaaatgaacacctcacgtttccaaatacttttaaaaaggacaaatattatactcatctagaaagtgggtatgcattcagagaatcagaagacaaaatccaaaagcttcttgactttataaatgcaaaattctaagattaattcattcaaaaaacaaatcacttggttgggtgaaaatcctaatatcgaagtaagaaaattcaccaaatctccagggctaaggattatcaaacctctgcctctgccaagttcagttcatagcaatgtctttgacctggctacaaacagagggcttggcttgctcccaggctgtctttcttagctgctctaatcaatgaagcagaaagggtcctttctaaagatgccagcaaaatttttaacaatcaacgtcaccttaagtaaaaattaaaagtctctctcccccacaccaagacggagtgttgctctgtcgcccaggctggagtgcggtggcgcgatctcggctcagtgcaatctccgcctcccggattcaagtgattctcctgcctcagcatcccaagtagctgggactacaggcacacactaccatgcctggctaatttttgtattcttagtaaagatggggtttcaccatgttggccaggctggtctcgaactcttgacctcgtgatccacctgcctcagcccaataaaagtctttaacttgtgactttatgacttatttttatagtcactgcttgtaagaaaaaatcccaagactctcaaagcatactgtattacctaaataggtaaagtcaaaagtaaagtgatctcactttttaaaccaaaatctctgttacggaatgccaagtattatgacagttagcaaaaaacaacaaaaaggccctattcacaaatcccatttgatttttttttttcatgatgcctaagcttctgtcccattcaactgaacaaagctttgtatggatgaataaaacagagccattgctttagttgcctaaaggtggtttaagacaaactattatcgtcacagaagaaaggtacaggtgtttcaaaaagcgaactggctgatgactttgcaggccaagtggtgaaagagcttagagatttggagaaccagtcagttcaaatgataacgggatgggagattctgaaaagcgcagataatgacttagaagagcacagagaatatctgctgagtgcatggaaggagcttgattggctcagataagagaggcttccaagggactgtgagcaaaacccaagaaacagggcagcttgggggaaaagaacttccatctgaagtcaaagactccaggcatgcgaaaggcacaggatccccggggggaaatggacaataaaagaggtgcgatttgtttaatttcaaccagagtagagacacccgcaagaatccgatgagttccatttctacctctcgtatccagcctttaccattaagactcactcagccatcagctcccccttccagagagcagcttgggaaagggaatgaagaactctctatgagaggaggactgagctggccaggcatgccttccgggctgctgttctctttgtttagttctattctgataatagatttcctttaaaagatacaatgtttaaaatatgggaagtcctagaaaacaaacttgctcactccagacaggtgataagaatccattactctgcccacattttttatctgcgattttttccccttagtaaccttgtgtagctttcctcaacttatactaagagctgttaaaaaaaaaaagggttccagtcaaaaaagtaacattaagttttagagatgaaccatgttcattaccatataaaaggctctaagaaggatgcaatgaaaaaaattgttaaatatctacatgtttaatctgtgtttcccaaatgtatctgagcatgtgacaatgacaactatcagcactcccctcctcccaacccaaacatctaccagcaacactgatggttccaaggaacacattttgggaaactctgccctacagcaatgctgacagtaagaaccaagcagaagaaacagccccacagcttgaatggaagctgatccactctctgtctcccctacccagtaacacacgtgaacctccagtacagtaaagcgggtgacggagagtgttgctgccgtggagggagaagggcctggtttttcagcaggggtcttcacgctcactagtctgagtcttcagccaggttactttaacctttgtcagcttcctcatgagtagttcctacctctcagggttggtgtttcagggacctagaaggaaacagtgtttcaaccgcactctaaaaaccaaaagctccctcaaatacaaggcattactgttgttagtaagccactgactgtgtgacagaaagggtgtgctggaagacacttctactgcacttagctcaagcctgctagcagagcctcaaacagtcaacagtggcctctcctgatctcaaagttttgaacacatggttataggagacaatattgttgtttaaaacaaaaaaacagaaacaactttctaaaaacaaacagggcctaagtcatgtagattactgcagcttcaggaatatatgtaagccactattttattcaaaataaaaagaggacccctgaatcagattcagaagaaacctaagcattgaggaccaccaggggtgcctgaaattcactttatttctagcacttcatcatcacagcaaaagatgcctcaaaccaccttttcataccttcatataatttgaagagaaagaaaacagcttattttcagtcacagagatgtattaactcataattcaaaataatttattcaaaaatttgaattaggaaatggtacagcaggaactagtgacctctccactgtctgatggagagaagaaatctacactaacacaaccatgtcaggagaatctcagccatctaccaatgcatgcaggtgggacattctaaatgatgagctaaacagtccttactacttcactctatcagaaataaagcaagtattcttaaagaaaataatgaagtactgaactgacttttcaggagtaacagctacactagaagtgaggaatagacggggagacagattccatcctggaactgccccatccacacacatgtttctgggatgtttgtaggacacgggtaggctgcctttgaataaactgctcagccaacatttttgaaaacttaactgcatttcttttagagtccatgtggcctgggtaatgcttattaaatgcccactgaagtgtgcgtgtatgcatactcacatgtgtgctgctgaaataatgagagcagcacaggctccagccttgagaaattattacttcaagttgacttccaggccctcccaaatccatttccctcaaacgtaattggaaacaaatcagaatgagactgtggcaacatattatttttaccagtttttaactagcacatgatttcagaagtcaatatgaagttacacttccacttgatatatataaaagaaaatataacagtggaaattactaaagaagagaaaaataacttctttttatcagtcaaacatgtagccaggactcctggggaaaaaaagccaaccaggcaattcaaaagctgcaccgatggccgtttaggaaagtctcttggcagtaagccaggtaaaactaaactctttccatctcctcctcaattacttttgcaactctctcaaaaggtagagacaccttttctaaattcagaaaaggtgaattattttcagtctaatggcctggtcactgtttctgaaattacataccatattacctgggagcttgttaagaatgctgatttctagtgtcgagccagagcctacaatatgcatttctaataagtccaccgggtgattctgccagcttagaactggaggcggtgaatcaattactgcttagtagctcctcctggtgttagtttttcagaaaataatcagttttcccaaattgtgcacaagcagcaatgatttgatattagaaaaatgagtttgtactcacgtacactttcacagcaaggaaattagaggtaagaacccttcctactttcttgggaaactgatcatctgtattataatatttaaattttatttcaataaaacacagtatttaaaaaaaggttttctagtttgtcaattttttttttcagtgtatttggaatctatatctggacagagtacctgcaaaaagtaacagattcacttaaataattttattataaacataaacttatgttttatgctgttaactatatttgaatacaatcatcaatttaagatggtctcaacagaactgttgagactttaaagggtgtgttcatgcttcacgtgtttgctgttgcttttacaagcgaacagttctccttgaggccccgaggcctgacagttgctggggaaatgatgggacagacgtgtctgctcctgtttccatccttcttctgcctggctctgccatttctcttactctgcattctagacctgccaccaaagattccagttcattccccaacacacctgcttggcttatggaggtccaacttcaatacgctttgaaatggacaggtgagcggcctgactgggagaaagcattcgggcaaaagtggagccactcagaccacattggtgaccactccacagcagtctaatcccacttactgtccctctctaaactggggtgcagtagacagaaccacaatccctgcatgtctgagtgacgggacatgacacagggccattaggtaagaggagccgctggcaggggatcaagggaggacaatgtccaaggactacagactagaacatggatgctgggaattttactgggcaaagtaggttttttccaagttagggccacttccaacaaagctgaatagggaacatgttctcaaccacggtctgagttagtccttactgggctatttgtcattccactagctgactgctaaggctcagaaaggttaaattcctgccaaaggtcatatgactcacaagggcagagccgagactgcgatccaggtctgcgtgatgacacatcccggactctttctactacaccacaccattcttgcatctgttactgctagtctttaggattgttttccttctcagttttgatggaaataacattttttctatctccactgtcacttccacaaagtgagaccttgggtgcaggaatattacctaacaagagtctgatgtacagcatttggtattattcttaaggattcatgaacaagaacactgcgtatgtataaatgaacttgtccgacttaagagtcaacctgttgctaaacgacactgatgcaatcagatgttaccgcagagttttaaataatgtcaatgataattattttgcgattcttttactgaaagagctgttataagtaacttgggttcttcttggtcatgatcattctaaaacaatagaatggagtttatttacatgatctgactgagaataaactttttttttttttttttgagagcaagtctcactctgttgcccaggctggagtgcagtggcgtgatctcagctcactgcagcctccgccttctgggttcaagcaattctcctacctcagcctcctgaatagctgggattacaggtgcacaccaccacacccagttaatgtttgcatttttagtagagatggggtttcaccacattggccaggctggtcttgaactcctgacctcaagtgatctgcctgcctccgcctcccaaagtgctgggattaccggcctaagtcactacgcccggccaagaataaagtaaaatttcttaatgttacactagccccaaatgaaaaaggacagcactctcttctctttgctttcccacctcagaccataccacttgatccaggcgctcagcttacaggacccaaatactgaagcatgcagatgacaaatctgtcccaactctcctttctgcaagatggacactgagtcagtgtgagatggcggcccctgggggagtccctggcatcagtctcttcagctttctctattttcttaatagatggataatggagtagaagctctatattttatcatgatctcagcaagataaagaggaatatattttaggaagacactgctggtagaaaaccgaattccagaacacaaaaacctcagtgaactcttcttcccagtaccacagattaatcacgcctatcctgcagaaagggaaggaagggggaagtgaatagaggaaagggatggatttccaatgatggcttacgaaagcgtgcttccaactcccctcccatatgctaaaggaggagaggatgatggtgccccagctatctgcttagacttacttcctccaagaaaatgatgactgcacatttgctttatgccttaaagagtctccaagtactttcaatccatacaatttcatcaactgctaaagtgagcataggctgtcatccacatttcccaagtgaggaggaagaagatcagagcaggtatggtgtggtcccctcgcctagaagcaaaaagctggaattctctctgcccagctctgaagtgggcaagcttaacctctataaacctcagtttccttttctggaagtccagggaagacctagatggtcttttccagctataaaatttccagtgtgatccaaagtcacactgagggctcagtgacagagctgggacttgagcctaagtttctgacttttaaagcaatcagaccttacagaactacagcaaaccacctctaatgaaaaagaatttgtggtatcattctaacctggctcctggatgctttaaacctgtgagcaatatctcaagaatccagactgccaggagaacagatttgcctaaaagataaaggaacctccatcgctgaccacgggtatcgtcctggccccatgagagagcttgtcacaggaagtgtcaaggaaaacatgaaatgcacaagcaccactggaatgcagcaatctcacagtactgccccatccccgcaatggagaagcagaagatgcaatgcatgccgtacaagtgccagctacatcctactgacaaactggaagatgtacaaagaagaaaaagcaaagggcccaaatgattcaaagaaatgaacaagttaaaaaggtagtttgggggacggaagagcaaagggaaaaaaaaactttagcataatcaagaacttccttggaataagtcgaaaagcctgcagcattcaatgccagggaactccctcccctggaacagagaattgctttagggggaagctcacaaggctgaccgcacctggggaacaattgccaaggagacaaacttctgtgacttacacacagcaggtcactcatacactgatacactcatgacattcccttggagcacttcaccccacagacaagaacaaggttgacgtgtatgaagacaacctgcactctggagacatcaatcaaatttggatatcccaggcctggaatagctttgtactccactccatcatcttatgatttaaaaattactttttgggcttgctcccattctgaaactcctatctctttgccagaatccagtatcaacaaaaacctattggttactctgcattcctaaatcttcctaactgcttgctactctcaaccttgatttccccactagccaggagtacacagagggcaggggcccggtggaaccaggcactctactgcttctacacctcacttcggtcccatgggatctgggcgaagatctctatgaagggaatgtaccagacctccagggtgggggatggggtgctctgctcagaggactggggaattatattccagtaaagaaccaagatatggattctcctgggacaactatctttcttctctttgtttgcttccagccctgacttctactaatattagtatacacagcaagaagacttattgaaaggatttaaggaagaaataaactaggacatatgagggcaaaaataaattggacactagcaacttcacacttgcaggatgaccatgacattgtgaacttcaatgtcacacaaaattaaaccattctgtggtgggactaaataaatattaaagaacatattattagtagattaaaaaaacttttttattgtgcaaaaaatttcaaatatacaaaaaaaattagtgaaccctaatattcctatcaacaattaacaaagtttgccacattgttacatcattgctttgttctttgctgaaatattttaaggtgaatcccagacatcaagtcatttcatcctgaatgctgcagtaaaaaccactaaaaagtacggaaatttccttacacaatcacagtgccattagcacatctaatcaaacagacaataatttcttggcatctaatgcgatctatcatcagtttcctcaccagctcatggacgtctttttatggttcaaatcagctcttaaataaagcctacactagcgcatgatacttgtatcttttagggtttttctagttaccacaccctattctttcccacaatcccatatttttttcattccactgacttattgtagaaattgggtcaattgtttcgagctctgtcccacattctggatttttgtttgtttccttctaagattgcatctctataacttatattttctgtgaatgaaaaatacttctagagatttgattagatttaggttcagctttttggcaggaagagttcagatttatactgcattatgtcaggagcacacaaggtctgcttgttctacttccgtggtactaaggctgaaccataaatagtaggttctttattagactgaaaaatactctttttctgttgaaaacagatttactatgaaagtgaattttgtataactcttagtatagtggataatgtgtctggattttagtaggaaggagaaacttaattctttcatagggctatcaattaagaagcaaggaaatcaacctgcaatgtaaaactacccttgattcccatgagtattaaagaagttcaaattagctatcattttaactataccaacgaactcatatagttacctagttacctagtgagcaactactaacgaccctgagccagggcctatgaaagtacaaagccatggcctctgtcatatgggcagaagaggaagacacacactgttgaaaggacagcatgccaggcagcagacagtaatcagcaaattcagaccaacgcagagcgcagtgagaggcaggatggagatgaggaaactttccatgaagatgtcactgcggtgttagccgccgggggcagtgactctcatcaccagagcctagaacagtacctagcacagaagaatttaataaaaacctgccaaataaaacaatgagccagaacgtgctcaggggcctgaaagaggcagcagcagagtgggtgacacagagctgggtgagaagagccccgggaggtccgtaccaggagccagcaagcatcggcatcagggaagcagattagcgtgagctgggcaagggtctggtgtgtgtgttaagggagctgcatctgtcatacgctgggcactgctgacatgggacagcagcattggagaagagccgattttgagaataagctctcaaaacgctctgaaaggatgccctgcaagtaggaaacactggggccggggaggctacttaggattacaatttaggggtcataatgattaggaatggtttcatcggaaggaatgaaaaagcaagatgaatgctggaggattaaaaatacaaaattagcaggccctggtaatgtcaaaagaaaaaaaaagaaatcacagatcacactcaagatccaacaactctagctaagtaagatatccaattattaaaaatgtgcttagtgcttgtactttgtcccccacaaccctgggtatgggtttaatctactcaacatcattctcatatgaagtgaccctgcctatactttaatcaaaaactcaagaaggacccccgagaagacttggtttgacgctacaaagggagttcacacctcggaatgaagtgaagactggtggcactcagctcattcctcttttctcttccacatcacaaatacagtttccactaatctttcccaataggacaattattattactaagaaaggcaaatgcaataggtgaggcctgtctctcctggcagaacacctcacattctttctgtgggaaaggaaaatggagccaggggcaagttacctgacctgctgcgacctcctgcagggcgtgcttggaggaaccatccagcacagacagcctgctggctacaggaggcacacgcaaaagacatccacgtcagggtaataacaaccagcatgtatttatggaggttcagagcactttctgcaacccaccccatgtttcagtaagataagttaggaatggcatatttccatgatacactttagacaaccagagtactcgaagattgatgcttaacttgcaggaagaagccatactagtgctgagtgggtggcagagcacaggaagaagccacactagtgctgagtgggtgacagagcacaggaaggggccacactagtgctgagggaggaggcagagcacaggaaggggccacactagtgctgagggggtgacagagcacaggaaggggccacactagcgctgagtgggtgacggagcacaggaaggggccacactagcgctgagtgggtgacggagcacaggaaggggccacactagtgctgagtgggtgacggagcacaggaaggggccacactagcgctgagtgggtgacggagcacaggaaggggccacactagtgctgagtgggtggcagagcacaggaagaagccacactagtgctgagggggtgacagagcacaggaaggggccacactagcgctgagtgggtgacggagcacaggaaggggccacactagtgctgagggggtgacagagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagggggtgacggagcacaggaaggggccacactagtgctgagggggtgacggagcacaggaaggggccacactagtgctgagggaggaggcagagcaccatctccttcactgcacagtgggggctttctcaaccttcttcaggcttggatccaacaagctgcagtaggagctcatggacgcacgtgtgggggagaggtctccatgacaccacggccgtacttaaatacaactcataaggaagtaaatctgaggagcaaacagagtaagtttttgtgttttctgtttgtgttttaaaatgggaatgatgccaggtctaagatttgaaaaatgcaaccattcccacccccctcacatgtattgagaggaaacagtttataacattgtggaaatgatggatgagaaaagggtttgttacacttttgaattgaaagggttttctcttagtctttctccactcctttccttcaataacgatttgctgaataccctgagcctaatggcccaaccactttccagagtggggaacagcagccagtgtttcctctacaagagaaacatgtgagggaacagaaggtataacccctggaaaaactgacccccagaggctctgccggcaggccctaggatgcagcggagggcaggggaggcgctcctgacaggagggaggccagggcatgtaggaggacctccccactagtccaccagagcccacgtccatggccccagcgagagggcttctctagagaagccaagccccagtgacagaaagacccgccaactctgacatctgggggttccctaaggaaatggcaaactccccatctgagaaggctgcctctgcaaacagcttccaaatggctcttcattaattgactgttaaattacagcagacggcaaaggatcatcggactatgtgggggaaatcctccctcatgaagggagcaaaccaaaaccaaaagaaaagaggaactcagaggaccaagacaggaaaacaatctgcgaatgtgtgaaaaacacaatgcctccagaggccaaggaacatacggttgtatccgtgagacaagaacaggacattattaaaaaataacaatgagatagtaagacatagctcttgaaaattaaaaatatgacagcaaaacttaccttataataagaaggttggaaaataaaaatcaagaaaatcccccccccacccccccccccaccaaagtagaacaaagatacagtaaaattggagacaaaagaaaaatctgaggaggaattcaagatgtcagtgcttcaactactggcttcctgacaaaacagaggggaaaaaattatgaaacagctaatgttccagaactcatgaaaggatatgaatcttcatactgaaagttctaccaagtgcctggtgaataaaaacgcccaaccaactcattcccatagggttttagaatctgagcatgttaagattctaaaaccttctgaaaatgagataaacaggtctgtgctaaggactaaaataagaactgcaacaatggctatcagaagacactagagtaataccttcaaaatgctgaaggaaaatgattttcaactcagaattctatacccagaccatctgccacagtattaatagagattttcagacctgtgcccttttcagaaagctgtggaagatgagtgaggacacagaggagctaaaaggagcaaggctggggaaaagtccaggaggccagggaaatggccgagccagcacctagtcctgagggagccgggaggtggaaatcttaagagagaggtctcctgggagacagatccagctgacagatgatctgatgcagctgacacactgaaagttttatattaagaggctaccaaagagtctagagggaaaaaacaaaatcacacagatatacagaatgcttttgtttcccatcagaaaacaaccaaaaattgttacaggaaatgttattattgtacactatttggcttagcagggtacgatatttacatagcaataaaaatataaaccccaaataacaaattcactaatcattatacaatacaatcagtagtttgagtggtgtaaaggcccagatcttaatctaccaaaacagaagtccacattttaaaaattatgacatggaaaaatgtcaatgcaagttattattgtaaaatatgaaggtaaataccaaataactgaggaagaattgaaagtgctgtagggaggaggcttgtgaggtggagtggcaaggatgactacagaatgctctttctttaaaagctgtttggcggagcttaatttttttacatctaggtgcgtatattactttgattaaaaaataacaagcatttaacacataatcgctatctatgagtcattgttcaaatgcttaatgtgatctcatttaattctgacaacagtcctaatagatgatgttactattatccctgttttaagatacaaaaattaaagtacagagaggttacatagcgtgtccagtagcgcagtgctagcaactgatagagccaagattttaactcacgcaatgtggaccagaagctggagatcttaactcggaaggaagccaggaaaagataatttcatcttgggaaaaacaatctgattttcacctattggtaaacctagatagtcaaaaccaatcggcctatctgacatgaataagtaggaagcatttattttctcatatctaaactcctatatttttctatcaacaacacaaaaacacagcctaaaaagcaagagcagcagaaaaggaaaagttggaaaaaaaactgcagtcacacaaactgtagttaaaaaatgactaagtttccttgatatatgaatttgttggaaaaccatttatcaacagcctgtttctctctagcagagtccctcaagccgagagccatgtcattcccctttgactgattaattagccaatcagaggacatttttcattgtgaggtatgatggtttatttcagctaatgtttggtctctaatggcgacacattaaagccaactcggctattttagccctgtggagtgaccaaaaggaaagaacagaagataaatcaaaagagctcccttcagttccccttcagtccttaacaaaacccctaaggagcaagtggctggagggaagatcctctaccaataaagagaaagaacaaataaaagaaaggcacacatgtcttcaagcgaaagagtagccttcctgtttctgaagagcaataatttatctgttgatttacagaccactgacagaacaggccccaaaagtcaatatttagctcttcttccttttatcaaaagctgtgctcaatagaaaatatagctctgtaatgcttcttactcacagggctcattttccctgcactctgaattagaagaggctgtgagtaacccatctcaagcactattcacaccaaagtcactccagccagccaatatcccactgcactgtgggttctctaagcttcttacctgttcctatgctgtgagggcactgaaaacacaaagaagtgaagttcaagaggaggacagataggaacattcacacatccaggacaagaagcacatcttcaacatgtccactgacagcacactcatcaaagcggctctaaggagctcgtctttgctatgcaatcacacactttatcatcaccatcctcgttcatcattctaattttatgaatcttcgaagttgtgttagtctgtttttgtattgctataaagaaatacgtgaggctgggtaatttataaagtaaagaggtttgattttggctcacagttctgcaggttgcataggaggtgtgccgatggcatctgctcctggtgaggccttgggaagcttccaatcatggtggaaggagaagggagagccagcccatcacatggccagatggcaggaggaggtgccaggctcttaaacaaccaggtctcgtgtgaactcagagtgagaactcattcattaccatgaggatatcaagtcatgcataagggatccgccccaacaacacaaacacctcccaccaggtcacacctccgacactggggattacaattcaacatggggtttggaggggacacacgtccaaaccatatcagaagccttcagacaagacactactgtttccttccttcccaactgatttaacgatgacttccacattgctagttatattcctggaccccactggcatttgtgttggaggccgggacaagtcgtggctcatgctgcttttgccttttgatgccttgtccagccagagaactcctacccttcaggcctagctcaacttccaattcttctgtgtgtctgtgcctcctgacagactcagtgagcatgagcagctcccttcctgtgtccccagattgttcaaggcatatttcaacagatgaattcaattcagcaagaaccttattgagaacccactccatgccaggcataattctagatatgaggaaatataaaaattcctgccctcacggggatcccagtctcctaagggaaggcaagcagtcaacaagggaactaccgagcatgtcagcaggtgctcactactgtgaaggaaaacaagtaaccaaatgtctgtacttccacccaaaactgcagagaacatggtattagaaggtcactgccttagtcattacttatcttcaacatcaattaaacaaaactgacgcgttaggatgtcctctaccactgctgtaatggcaaaatggcagacaggagtcacttcactagaggactttgagaaggacgtgcttctcagcaatgaccctgttcactcagtaggtttatattaaatattgtgactacgcacacacagatacaattttctcagttccaaaggatgtttcctataagttattattggccattttaaactgtgagagtgttggtgctgactgtgacgacagtggtctcaacagcagcagcagctaagctgcactgggcatttaccatgtgctgggcacttcgctaagagttcttcatggcttattatttaatcctccctggatcttttattatccccatttacaaatgaagaagctggggctcagagaggttaaataacttgccccaaatcacacagtcttcaaactactcttgggctcaaatgcaggcatatgaaacgagatctcaagtgcctattcacaacactatatggccctgaaccagttgccctttagaagaaaccagagtagaacattcattagatgacctgatttcctcattctactggctcagatggttctaccaggtatatatatttgataccaggtatcaatgtctaatcacagaaccacaggaagacaaatcctaagacagccatttcatttatctacacaataaaccatcctgacactcagtggcttcaaacatatcagccatttccctgttcaccctatttctgtgggttagcaattcgaggaagggctgggctgggcagtcctggctcagggtctctcacgcggatattgtcaaaaggtggggagagctagcaaagcggggagctggccaggcacctgctccccaggcaagctcggggtgcctgcataactcactgatcatggtctctccacgggggcttgcctgggcaccgggcctcctcatagcttggggctcggggcagctggactatttacatgaaagcttcaagagcaagtgttccagccaacgaggcctcagaagtcacctggaaccctactgctagactgtcttggctacaagcaagttccaggcccacctgggtagaggggagggggccagactccacctcctggtgtggaggtggtaagggcccacttagaagagcatgtggaatgagaggtatcactgaggccatctttggaaaacagaatctgctacacaaacaagtaactcaagactcatttatagataactgagtttacagataaaattggaacaccctacccaaggtgaaggtaacttcaccttgacactcaacagttgcagttactctttaagtcttgaatctgctaagacagatgacttgctattttacctgaagtctatttgatctcttgtttggacacatcaagagcctttcacattcatctactgaataaagcgcataagtagataaagccaaaattgctcaagtatgtaagaatcaagaagaatccaagtaatgtcctctcctttgtggtcgaggaaaacgtaaaacttcaagtcaagacttaaaccttccagcaccgtttcaaatgtgatcatttcacgtgttctctttactccagaatgagagaaggtcagagctggaagggcttgaatgcatttagctgggactcttgcctggtaccagaacctgcacagggcactcccaaggagacgtgcactgtggccagcagctctgccagcccatgcaggctgcttccttttcctgagttgttacctttcgatgaatttcatcagtcagtgctagttcttcctttgtccaaactgtcaccctgataaccacacccatttcttccatctgtttctgtgcataacatgctttccagacgccactgtccctgaaggcaattccctgaacgtactccttgaaaacatgacacccatgacacccaggcccgcacagagccgttcaagcacagtcacctgtgaggaacacaagctacaagtctgttgctttcagcaagtgggcacagcctccctgacaccgcccagcctccctgacaccgcccagcctgcgctcaggacaggtgcgaccagacacaatttggcttaggttaaacttgtggtcaggatacatgtcctaccttctaactaattttcatctagctgctagcaaattagatctttctagaagtaaatgactgtacatatcttcctaagctttcaccttaaagcagtgaaaatgttttggccaactgtcccagctcacagtgatcattttgaatcaggattctgttatcaatggtcaaaatgatgacaagaattactgaagtcatcactgttgggaaaaaatgaattttggaactcaagtgtattaattggcttgtttgtgggcttatagttctccctaactacaaggttcttaattagaagattactttggtgtccagatgtggagtggggggagggtagagcgataggtgcaggaagggggatccacctcctataaacccctcttgaaaatcacctaaccataaatgttgggtatcagtgtgaaaattcagaaaaggagaaacacccttgaattaaaaggcacttgaaaaatgaaggcaataaagagactcttctcagtgatcttccccatgaggaacttaaggcattgaatccaaccagaaaaatgaatggtccaaaatacctcatgaattccaccaagcaaagcagaagcgtctgctcggaattcattttcagactggataatcagcaagcaatggggaaaaaaaggagattgacagagacgagaaaggaacacaaactgcaaagaagtcatgctttgcctcaaaaagcaaaagccagcagaagaatttcaaggaaaatgattattgatttggtatcctgggagagtgaaactctcatgagggttctaattcaatcaggttagagaggtgaagaaaaggagaattattttgccaggagcccatgccagaagcatgctagacagagaaacgaagtgagaatgctggtaacacattctccatcctcactctggtttcggagtattttctctagtgataaggctcaatccggaaacaagctggagagaggaaggaaactgggaaggtgggggagggaaaaaaatgagagaggaaaaaaaaaaagagtagcaggaagttcaaccagataggaactgatggaatttgtttttcagtgtctccaacttcaaattgcaaaccaagtgagagaagacacacgcttatgtacacaggccccggcaggcaccggtcagcacaagtacctgctgcaggtctcaaggggccctgggaatctcaattcattatcttcgatcatttctttgtctccacagaaagtgcatacatctccaatttaggtgcactccaaaccagttattatcttccaaatcaatatacaacaaagatggtgggaaaaggaagaacttggaaattagaaatgtgcaaccagccgtccccacacagaacagtttatgagaagttttctgagcaactggcagttcgtgatgatctttcaccattgaagcaagtacttctgaatagccggattcagcagggaaacagcgcctcctgacagctgctgtgtctggaggaaatacgaagcaccaatgaagtcagaggagagtccttcaagcagtaggaatgctttatcttctgagcaatgaaaaacagccacagctgtgaaaaactattctagagtgaaatgcaaggtctgaaagccagtttctggcaaattggattgatttttaaaaacataaaatggtgtgagcaaacatttattcaataatcctttctcaagaatccacaagtagattgtgcatggcgtagaatgtagattatgagtacttcctactctcagagaagaaatacttatttattagaacgtttcaaaaggaaaagacatttcaaatatcaaccatgatgctatacaaaccatgatttttatggcaacaaagtccattttttaaaaagagaagaatgatgaggcttcaactgactgaatccctaccacgtgccaagcactggagccagtcacatgctggggacccaggaatgagaacaaaaatcctctctaaggtgttcgctagccagtgtatgccacaaatgaaaaagtccacatgtaaaacacagtgaagcaatttcttctttttcttcgtttttttgagacagggtctcactctgtgacccaggctggagtgcgatggcgtgatgatagctcactgcagcctcaatcccctagactcaagcaatcctcccatctccagcctcctgagtagctgagactacaggtggatgccactgagcctggctaattttttaaatttttggtagagacgatgtctcactatgttgcccaggctggtttcaaactcctgagctcaggcaatcctcccgcctcggcctcccaaaatgttgggattataggcacgagccactgtgcccagctagcaatttctttattagacgcaaaaaggtcagagagaggacagaaagcatgatttaagtttcataaacatgtcctagaaatcttgcatttagcttggattgttgtttcgctttgatataattttcttttaatttctatacattatattcaaaataattaagagagcacattctttacttggcatagtttgttccactacacaacacaaagttcattcctactatgcgcacaaagaaaatttacattttaagtaatttttttttgaatgaagacttttaaatgcatagtcttagattttaaagcttctttttggaccaaggacaccttcgaaaatccaatgaaagctctgcacatgggcccacacatgttttgcatgcaatttaaaggaggtcacaaactcactatagtgagtgtaccctgagatactgccaacaccatgagctctccaacaccagcaggctacagatgacaaaactggtcacgataccactttgtacttacatatcacttcacagtttaacatacccctgaagttattaagtaaatgatttaaccaattggagtgaactttaaagacatcaaatgatttgatctctacaaggagttctctaaagactcataaaatagaaaataacactgagcatggctaagtgcaggaagtagatcatggaaacgacaatcggcctttagcactgggtagtgacccctgcagatctgagcagcctcagcatcaaacggagagaccatgtggtctgtacacacgatattccactcctaatcagacgattctgtcggcagctgtgattgtcagggtcacgggcggtgttggaggggtatgcaactatgattggggttagcacaagggaggccttggtggtaatgaaatagttcaggatcttcactgagataataatggttacacaatccacaaatgtgataaaggggcacagagctgtatgagcagatggtaccaatgccaatttcctggtttcatcatgctgtactgtagttacgtaagatgtaaccactggggaaaaccagatgaagggtacacagaacccctttactatctttgcaacatcctgttcatctataaaaagttaaagaaaaaaccctcatgactattaatcaagggctgcagatgtttcttagatataaatacattcagatcatccagttcaatagagagacgaaaaaatacacaagcaacacaacatctatgctccagatgctcaagctctttcttaattcagcctccagccaataaggaagtcaagtcgttcttcaggctggcctggacacctggtcacatgcttgtcaacccctaacagctcacctctgactacaggtaaggtaaagaagttttgaaatttaaaccattattttccacaaaatagcaacagccaatcattttcccacaaagttacgatacagcatcaaccactggtgtctctggtgaagctcaacagaagctgctaaggcctaactaacccccttcaatgtagattttttgttaaatgagaaagagttcattaacttcggcaggactgctgtattatcggagaaaggctgattttggaattggacggacacagatttaaaagcccacgtgtgccattttggagcattctaacaattctctctgtgcctcagtttcctcactgctacagaggagatactgatatttacatgacgggattgctgtgaggatgaaatgagaaaaatccagcacagggtttggcacacaggtgcttaataaaattggaattctacgatggcagtcaggagctgtagaaattaaaatcagtaggcttcccttattgcaagggtgatgctgttacccaagccaagaacatggttaacgccaacgttctggaactctggatgctgaagacagatcagcatcggcacctaactagagcacccacagagctactgctaccttagtggcccgcactaccacggtttccaggactctggagggaggtgacctccagcaacaccttggcctctgcaatgccaaatataaatccagaccgacggagctatgagagtcaagcgaagcaacaacatacaacattcccgccaactgaggatgggagccgaaagaggttgtattttcaaacaaatctgatcaaagtcctcctgcctttgactataagggctgttgtaactaacaaggttaaggtttcttagcaatagtctactcaaggaaggtaccggtatacctcaataaaagcaaacttaacatatgaacatccacaaggatgtcaaagataaatgtagaggtcattttgctttatagaaagatactctgtttgtcttaaatgtgattacatttaaatagattctgttttctgcacacatgcaggcatgtcaaaaggaaaatactgcctagacgcgacctcctcagtgtggcacacaggtcagcagcagtatcacctgggggctcctcggatggggatgtacaggctctcagcccccgcccaggcttcctgagttggaatctgcagtttgacagggaagacctgtacacacggcaggacttgaggagctctgtcctcagggttactcacgacccggaagccagaagctctcagtacagctgcatggcaggctatccccgtgttctcaaccctcgctccttactgaacgtcagaataactgctgcaacaattggggaggaattaaaaaaaaattttttttaaatttttctccttttgtaatatagatacctggaccctgaccgaagatttaatttaatcggtcttgggcagaaccctggcattagcatttgtttaaagctcattaggcaatgccaggacgaccttgttgagaactatggctacagacggagagcagggcctggtagaagaccacctcaccaacaggtaggacctaaatttatcactggaagaaaacactgaactggaagagagagagagatgtgactaatggaaatctcacacaaaacacgatgttgcatcaaggttgatcatctctacacacactggaccaaaagagattttcctggggctagcattagggaactgcttttgaagctcctcaaacacaggtggatgtctcactttaacatgacttagctaccaaagagtcaagtaacaccacacagtgttgaaaacctcaaggcacccaacacccaataaattctcaaacagaaatctgccagaggatcagaaacctctgatctcttacaactaagagctttctgcaccaaacacataaattctcttaaagttctacaaaagcccacaagtaacatttccctccctgatctgttcaactgtacattttcatagagggtgtccgggagggcaaaggctgggggtggtgggtgagcagcaggcagaagagaggatcaacgtgcagggatgtggaaacgccagtacagaaggcacgtgagccccacggggctggggagatgggggttatctcaaggtatgggagggacgtggagttgatacaaaggctcagggtgtgatcgtggggtgggggcagctgttgggcagagcaaaggagatggagttcaagaggcgcgggactggaattctagttcttcctgaggacacggagacgactgagagagtcaaggaagaggggttggagaggaggctgggataagccagaggccatgtccttggtgaacaaggaagagtggcgtagtccaggtctcacggtgagcactgagggcagaggtacaaccagaagccagcctgtctgaccatggctctttccagcagccccttgtgaaggagcagccggcacggccggatgtcagagcggctcctccctagtgaccactgcctatcccgtgactcagcatagtccgcgcaggcaccaaagccaggtatcctttcccagcctgctgcttccatctgctgagggtgcaggggcagacaggggctaaaagacccaggaattcagtcccaatctgcacagggaatcatctaatgagacttctaaccactggtaattctggactccctaaaaattattactattaagaaacaaaccaccaccctagaaataaagatttctgtcagtctggaaaaatgccaggaatcaataaaccaagtcttcttttttgttctatggtcaccaagggccctggctacaaaccaataaaagatcatcagtacaacataccagattagctgagtaacagtggtcacaaccatatattccagattttctcagacaatgccagttctaaatacttttagcctgttatctttagaaatccataatcctaatatatctcaaactatatccagggctgtctcttacacttcaaaacagcacaaaaaattctttgcaatattatacagcccaatttaataattagaataaattatggagttcattccattgagggtgtagtttagtcaccccattcttttcttctagttgtaaggcaaataatattgtataatagaggaaatacccatcaaacccccttatagatggtgctgatctagcgctgtctcaaatgctgttagaatgggacaggctggttctagagaatgaaggtgacatgcttcctcccacctccattccaagtggagtaatgcagtttgagcagaacagacaaaatccctccccttctcggccatggaagagatattttcccctctgattgtatcggcaatgggtgttcttccccaagtttaatctagtcctcacaccaaaacaaaaagaacaaaagccaaacaccagaaaacacttattcttttttttaaagattccttataaaacattatctacccactaatattatgaaaaggatcatatctaggctgtgcatgaagcctccaaagtgttttggaaagtttgtcagaaaagtactagtcatagatagaaacagtcctatacacaggtgaaaatcagacagtattaaagcggaacacggaaactgtacgtggctttatacctcgggagtcttcttactctgtcttttcccaaaaatgcagtcaagatctgttttgctccgagatgacagatccttccctagaaaaacaatgtgatgcttttcagtaagactgttcttcctaaaagaaagagcgcagacatgaactatgcagcacctcaaaggaaaatggcttttgggaaagaaagaaacaattttgaaactactgactttctacccactttttcattacaactctttcattagtaaacaaaattaattaaattttaaaaccaagtaaatgttttagaaccagaactcttgacattctcttaattgtagaaacaacctagagcatactgactgcaaggaaagctaaattctacagctcaccctactcccgctatgccctcaagatgcaattcctgggtctctgggttcttcatttaaaaatagatctcatttgcttcagagacatgagctacttacttagaagattacgaaatacacatgaaaaaatatcactagatacacagctccagaccccacatatgcacatgaatgagaacgtatcatatttgacacacaggatcttaataattaactcaacaaataaaaattttaaaagaatatatgtaaatcaaaaatactgtaaaagggtgacagggtttcagatttttcttcttaaaatgttctttactgctctagctatattgtctctaaataaaaagctacatagggagagtaggaaattaaatggctctatggttcttatttaaaacactaaactctttaatttcaaacccccaaaccaactaatttaaaattcacttctttggaatttccacttctacccaataatcctctgtgagcagtaggccaaatctagtcccatttgtcaacggcatggtaaatgcattttaaaatgtaactactccatgtaaaggcttgaggctctgggcgagggaggttctgggtcagacacaggaatgtgagtctcacgctggaagccgagttccaccgtcacagactcacttgtcttcttggtttcctgtagcacactgccttggcaaagtaatgtcatgacccagaaggttctagttcactatcactggggcacttaaatatgatattgctcagtgactccgtgaaattaaaaaaacaaaacactcttcaatttaatgcaaaaccaggtgccaaaaccagtttcctaggcagcagtaccagatgaagtggcccaggcggtatgacctgttcctgccaggagggcaggctcctctgggctctggctgctgctctccttcctacctgagcttgacactaagccctcctgcttttcatttatgattaaataggacctacacaaaaagacccaaaagaaaacctacttaagaatagacgatgcacaccacagatacggcagaaaatgaaccgggaaagtggggaagaaaactggttgtagcgggaagaggtggacaaactcatcggaggtgtagagatgtcctcacagctttgctgccagcacaacccattttccaatgcaaagcacagtttgtacttcagaaaaggcagctgtacttaattcaaaatgtgtactggccatctatccctaacctatcctctggaatagagacactctagaaaatgcaaattaaggtctcttctatagcaatttgactaaaaggaatgctggagggattaaggaagagagggtacatgcgagatcacagttctaaaacatgatgtcaaaatgtgaacacacagattcaaaacagatctgaaagtcaaagggaaaactgtcaagctggtagagacagtaagctatatcaatgaaggtgcaaatgtgtctaaagttttgatgatggattcttgtatcagaaatttttagcctttagcaaagttcacttaagtaaatgtagaaaccaggattgttacaggccttgctctggatttgatctggaaaacaagaacacagagaagaaagaagagtcagagaccagtggaaaggaacataaaaggtggacaaaaaggtgaagatggaagtgaccttgagatagttactaattaatggtcctgatggaaagcttataaacaccaggaaattatggccgcttttgaataaatacgacaaatttaaaaagcatttaaaaagcttatttgtttgagttctgaattatggtcaaatcatacaaaatactgttgataaacttagagaaaacgacaatgaagaaaactgaataggaaacatctatctggatttggttcatctattagtcttcaatgcgtaacatttccagaaccagtaagaaaggcctccaagagtcaaactgaaagttcctgcaaggatgagcaggtactttcaaggaagaacactctatttaggtttgctttagctgtttgtctaataatcatgattatcagtttcccagtctatcagagtagctactgggaagggaggaacattactgctatagtcagacacatttacaataccaagaaatacacatgggaggcaactaaaactttcattgacacgagaacttaggaatcaagatgatttggaaacagtttagcaataacccaacaagctgtattagaactgaggctcaaaaaaccaactctatggaaaagcagagttgagctgccgagagtaaagaagtgaagggcaaggaatatgtttgctaaaataaaaaaacacttaaggtttatgtaggtagcttcaatagtttagaaaattcatttgcattattcaatcaagaaggacaaataaaatgacatacttttatttttatctttttaaatggcaaacacacagaactggcagtcaaccgagggcagaagataagggtaactccactaaaagacaccataaaccaggaaagtggaaagagtcagtgtgagtgacacaggtcagacctaccaggtgctacctgatatttatttaaatgtcaaaagaatcagaagaggagattgaatgctcctcactaccagtgtgcaactgaggggcggggctgactgcgctgtgaataccaattctgtatttcccgaccaggaagccgagcacctgcacatgcgttaggcatgtagtttccttgtttcagtagcatataaaatagcccaaactctcaaaaggattaagaagtctgcaagattcccaggataaagctgcacaattacagtttatgcaactttcatccaacaactgcataactgaggggaggaagcactgctctcctgctctcctgccaacgtctcaccatccagtcagaaaacctcagaaatggctttgtatcgattgacattttcccctctgcagatatagcctctatctgcagagaccttttgcattaaaaaaaaatacaaaaaactacaaaccaagctggagttgagcctttaaataagtatgataaaactgacatttaaaattatacaataaattagctcaagttagaattataaactcaggaccagggaaaggaataattatatatcagaactaaaacgatataaccaaccaggtgcagtggctcacacctgtagtcccagcacgctgggaggctaaggcaggacgatcacttgagcccagaaggtcaagtctgcagtgagctgagactgttcctctgtgctccagcctgggcaacagagtgagatcctgtctcaaaataaaaataaaaataatgatacagctgatatttaggcagtagcaaattttacaacactatttgctactgtaatcttagtagagtaaaattttaatcttcactcttcccaagctatgtacaattgcatcttcctgtttgatttcctggacgatacatgagttgcaatatgaatcatcctcatcaactaagtgaatgagttacagtcgttatcagcatacccactggcgaaaatctttattatctacaatgctgaaaaagcaaaagttccatgaaatgggtcatttctaataaatcataaaacagaacctaccttagaacttaatagtcacttacaaatgtatccacattttacaaaagaggaaactgagtctgaagggaaatgggtaggtgacttgtctgagcgagtaatggccagagtgagattttctgtgatctaagatagtccaccctagaggaaactttaaaataagtgtgcaccgtgattggaaagctagctgataaaccattcttttcctcactccctggacttttgcttccttctccctttcctacgtaggcccagtctgcatgtccttcccgtctccactccagctcttctctgcaatctgacaatagatccgagaatccttctgttctgcatactgactccctcttctccccaggcaaggctaatagatacagaaccctcgctggaagacagaaaacgaaggcacgaggcactcagcggtctcacagggtcacccagcaaaggagtggcttaactagaaatagaaagcagatgctcccggcatccattagattaaagcagattacagaggcttatcccagcctcagcaaatgcttcagatgaaatcatgcatgcagtctggcatcaaaggaaaattagaagattctacctgtaaaagtgaaagcgtaaaaggctgccacatcatccgaaagttacaggtcactgagttttattaatttgctctgcaacagcaccttctgtgatctctagtttttctctacagtctaatgaaagaagaaatgctatttcagggactgggtatgaagtgagcatgtaccctctcttcaaaaggactgagggccaaggaagcctgtattctgttccatagcacgctggggtggagaagaaccccagtcagaagggatacgggcgacagccaagaaagttccatgtgagagaaagaacggaggaagcggaagagccacggctgctggagagggaagggaggcccagcctctccctgcacacaatccccaatccactcagctctgccacggcctctcacctcaaccaaacccagccctcacttttgggctcctggccctaaatgaaaagcatcatcaatacttcagagtagtggggattccagctcccactgctatccaggctggctgtacaagttaagagcttcccagcaatgccctgatacgcatgacattcctagaagaccaaagcagagatgtgctgttcctggcatatcaaggtagaaacacatccaacctcccaggaaagaaccatcaacagagactagatattacagcatcagcagcatcatcacgcttcttatgtaaactatgtaataagtaggtttctaattcatgatactgttctacagacaaactggggagttggttctattaggttaaattgcttctttccaatgcaagatcgccacctagtggctgaagacaacaaccgcatgcacaaatgatttcacatactgggaaggggctagggaggtggtgatgaaggaataggaattctcacccaggtctcaaacggctttttacccgacttggcaatgactatggaatgcctacgctgtgaaatggagaaattacgtggaataaagggtcaaccagggagtgtgctttatcacactggaggtatcaatatagagcataattctctaacctggcgtattaaaagctatttaacaccaactttcagctgtgaaaaaacaccatgcagctaaaaatgttgggcaagaaattaaaattattttctgacctagctacataaagtcccgttttcctctaaatataagctgattccattttttagctcagccacaggacttgtttacagtctaaaacctaatctgggtcccatctcagatctcctagatctgaattctaacaagatcctcaggcacaccacagtcaatgcgaagactccagcgctgtttcacagcaatgcagtcggagctgtccataaagcatgaagtcgctattggcccagagctaaaatgcttcaagcaactcaggacaaacacgtagatttcaataacaagtaaagaaatgcttaatcttaccttttgtgaatttcatatagtgaacacggtttttggagattttggacttttcctcaaggctaaaagatttcttttccttcttgtccgaggaatctttaaaaaagatgaaaaaaatacattaaagtctttctaatccaatctcatttattctcctaacagtggatagtcttgaaagaaaattttaggagccctatcattaatgattgaactctttcattcatttgctctgcaacagcacccttctgctggatctctgttttctttctaggagtcaaatgattagaaatatttccttaatttgcatactatggatcaggccaggctgccctccagaaatttagaaaatccttgaggaagaaatggaaacttgtgttcacacaaaacctagacacaaatgttcacattagccttattcatcatagcaaaataccaaaaatcacccccaagtccttcaacgtgtgaatgcatgaacagctgagcaacccctgggccatccttacagtggaataccactccacagtaaagagcggcggccgctgccaccgcaatggccaaaacaaactccagggcattgtgcttagtcagaggtccatctacaaacataacatatgactccatctacagaacattctcgacatgacaaaactacagagagagaggacagatgaatggtttcgaggggacaaggatgaaggtacagtgggtacaaatacaaagatgaggcatgaggttgctgtgccgtggtggccaatcctgtatcttcaccattgtggttgctgcatgaatctgcacttgtgataaaattgcacagaaccatccgcccatgtacaaatgaatggagaccaaaaaaagatgatgaaaactggctaaggtttgtggtgcagttgacagtaacaccaaatgtcaacttcccggttgcgaaaagccacagcaatgtaatgtctctccaccctgggagaacagggggaaagacgttcaggactctctgaattattttgcgaattcctacaagcctgtaattatttcaaaataaaaagttcctttaaaaagtaaataaaggtaagacaggttaaatgatcacctaaatacagatcagagatgacgattaggtgacgcatggaggagcagcaatagctccaagccaccttttcagggtttcgggaaggacaactggaagggcaaaaggagcaggaacacaccattgaggaagacatccgagtggtaacgcctttgacggaagggaaaatgtgagccagaaagtaggtccttgcctgaaaggttgatcagagcaggttgatctggggttagagtcaattataaattagctagccacctgcattctctcacctgtatctgcttgtcaagttcagacagaagagtgccacagaaacgatcataggcagaagagagactaaattttcctacagttttaagaacattcagatatgaggttagagaaactggaaaaaaagcagccgggcgcggtggctcatgcctgtaatcccagcactttggtaggccgcagcaggcagatcatgaggtcaggagatcgacaccatcctggctaacatggtgaaaccccgtctctactaaaaatacaaaaaaaaaaattagccgggcgtggtggcgggcacctgtagtcccagctactcaggaggctgaggcaggagaatggcgtgaacctgggaggcagagcttgcagcgagccgaaatcacgccactgcactccagcctgggtgacagagcgagactccatctcaaaaaaaaaaaaaaaaaaaatccaacaaaccaaccttcttcagaggatataagagaaattggaaaaaaagaaactctcaccctgacagtggagcgaaacaagcacgtgtccattcaacaacatgtgactgcactgcaacccctcccaggagtcacttatttcaaaggtatagttccctatgggaactatacagcaggctcgaaagaacgtgaaggcagatgttccgcacttgaggcaaagcccagcacgggctcattatttccacaagctgaaacattctcttctgcagccacttcccagggacaccttggattttttgcaaagacatcctaccagtaaattcttctcttttgcacttcatatggcacataacattttcaatgctgatgttccaatcacaaatcacagaggaagttatcagcttaaagcggctcctaccgactgcaagtgtatgagggacgaggcgctggactggaggctttccatgaattcttggatttccttcccacagccactccataagagagctgctgtgatgcctgaactcactacagaggacgacactgataaggcacacccaggaagcccccgcgatgggaccgaagcccaggcagacatgacgcagaggccacatcctgaagcaccacgccgtgccctcacagagcagctctctcagccttgagagggcagaagaatcacctggtgagcgtctctaccttctcagcatgcaggtatcaagaaggatgcgtgagcaccgccaggccttgaggaatcactttctatctatttgttcacgtgcactcatgcctgaaactgctcggagtctgacttatgcaccaatctggccgtcctttcccgggtatcccctcccactttacaaaggaaaggcacaactttcctcttaccgggatcaatgagggacaagggaaaatactgttgtcaaagcagcaatcaaagcagctggcccggccctcacacccctacgctaacccagctcatcaggaggtgcactgccaaagagatgtgtttaataagcattcattaaaatgtataacagatctgctaattttattcactgtgatctactaatcatgagggtaggtgcagtggctaaagcctgtaaccccagcaccttgagaggctgaggtgggtggatcacaaggtcaggagttggagaccagcctgaccaacatggtgaaaccccgtctctattaaaaatacaaaaattagccaggcgtggtggtgtgcacctgtaatcccagctactcaggaggctgaggcaggagaatcgcttgaacccgggaggcggaggttgcggtaagccaagattgtgccactgcactccagcctgggccacagagcaagactccatctcaaaaaaaaaaaaaaaaaaaagagagagagaaaataaaaccctagattctttatgaaatccttcagagtaaagtaaattttctggccttaatcgtggtttatggctctagatttgccagccacactatcaggaggcttacagtgctgagtatctctgcttgcttttcttagatgttataatgcatttagtcctcacaacaaccttccaaagatgatactactgcttccatttaaccaaagaggaaatcgaggtacagccatgttcagcaatttaccgaatgtcatacaaatgaaaagtcagaccaggattaaaatccaggcagtctaactctggtgtttgtctctaaaccactgcattctatttaatctccaagtcttatatgttcatgcttacattcttacattctttttttttttggagatggagtttcactcttgttgcccaggctggagtgcaatggcgtgatctcgcctcaccacaaactccgcctcccaggttcaagcgattctcctgcctcagcctccaagtagctgggattacaggcatacgccaccacgcccagctaattttgtatttttaggagagacagggtttctccatgttggtcaggctggtctcaaactcccgacctcaggtgatccgcccgcctcagcctcccaaagtgctggtattacaccgtgcccagccaagcttacattcttatctgtgtttctactgagttcaactgtgatcgtaaatatcaagatgttttctgtgtataattagtaaggaatagtgtccttgaactttactacttcatagatcctgcatttcctaatatgagtcattcagtattttcagaaaacattttccttatctttttcttctgctaataaattattgcccttcatattaggaccacacacagaactgttaggttatttcaaaatcatgatcctatggataaggaaaactgtccaagttatacattccaacaaaaagtccaatctggttagaaaaaataccaacaaagcacctttcccttcacactgttgggctcacttccacacacgtcactgcaataaaccttcctatggttagatgtgtgctgtgattttaccaggtaattaccagcatattctgctagctacctccaagcaggactgtgtcttatacctctgcagatcctcacacctaaactagtacccagcacacagctcaataaatgtttgctgaactcaagtctaattcattatttcactccacaaaattctttcaatctaccaaatatcttttgattattcacacatgacacacaaggaatagactgttcataaacaagaatgtttataaaaatgcttgcagattacaacaaaatccaattaaaaaatgggcaaagtacttagacacttcttcaaagaagatataaaaatggccaataagcgatgaaaagatgcttaacatcagtcattagggaaatggaaatccaaatcacaatgagacatcatctcacacccattaggatggctattatcaaaattataaaagataattactggttaggatatggagaaattggaactcttatgcactgttgatgtagccactacagaaaacagtacggcagctcctcaaaaagttaaaaatagaactactatatgatccagcaatccactcccaggcattacccaaaggaaaggaaatcagcatgttgcagaggtacctgcaaacccacgttcactgcagcactattcacaacagccaagatatggaatcaacctaagtgtccaccaacacatgaactgggaaacatgtggtgcatacacaccacggaatactatttacccttacgaaagaatgagagtttttcatttgaggcaacatggttgagtttggaggacattaagtgaaataagccaggcacagataaatatcacatattctcgttcatatggaaaagctaaaagagttgagctcataaaagtagacagcagaatagtggttattagagctgcgtaaggaaaacagctatgtaggaacagctaaagattggctaatggatataaaagtcccactacataagaggaaaaagctctagtgttctatagcactgtagggtgactataataaataatattttattttatattttcaaatagctagaagaacagattttaaatgctcccaacacaaataataaatgtctgaagtgatatatatgctaattacgttgatgaacataacacatgtgtacattacaaattgtgcacaggtattgacatatcacactatactcaataaatatgtataattatgtgtcaactaaaaataataaaagcaaaaaacaaaaagtagataaacatatttgcattgagaacttatgtcatctgatttccctacctgtggtttcctgcccatggcaagtgttcagttcggccagaagctggttaaaatcatcctgatgggcaatccagttgtcctgaaaatatcaaagaaatgaacgagaggtaagcctgtagtttacttacactgactgagatgatacattttggaatcaaggaaatccagtggttaattaagaaattttaaatgttccatcaaaatactatttgataaatttaagtggattcaagaaataatataaagttaaaatgctctttatccaggtcaatattaaaaaggggcttcctggaagcttaaggcctgatttcaaatgtgaatgacttatcgatcaagtcaatatatagtaaataatcaacaggcaacctgtgtgctaaatgttaaagtaaaacataatgaaatgactatttttttctcactaggggaaattccatagttgaaaggacaagaaccatgcgggacaaaaaaatgctcttctttgcttggtagaattaaaatcttctaatgacttgcatcaactccaattttacaaaactctgaggaaggggaggaggaagaaccttaagtcccctgaatcgatgagttcccatttgtaaggtggttacctaataagtttattataaaaaaatgaacctggcttttataagagaatgaagatctcccaaaccagtgggaagcagggtttcagtgtacgaatctgccttactcacattcttagcaatttttaagaatgcttaaggtaaaggaatatgaaataggtttactgggcaatgcttcttctaagaaaataagtatatctgtgttatctatccctcaacaactacatttgaaatcaactttatataaactctttctttagtggctaaaaattttagctccgccaatccactactcagagatacggaactaaccaaagtaattcaatttacctaaagtaatttcccagattccctaccagattatgttggctgcaaaaacttagaaacaaaacttttcagtttagatcctttccaaaagggaacaatgatactaaaaataaaaagcgcggtaggccactgactctgagttatagtgccatgcattcaaagcgtcagtgttcaagaggaaacgtgaataaaaagaagtgctgcaccaatggtcagaagcagatgaaccaatcaactttcagatttacaagactgaagccaattatgcaaagacacccaggaggcacacactgctgctcacttcattattgatggtagctccgagtcccaggtggttatttttcacttgaactttaatatgatctgtggctccttgctcctgagcccctaaaccctgtggagattaaacacagagagttagaacattcctctcactgatactcagaagcagagcactgctacaaaactcacagatgcctacggcaggtgttctgagttgatgattctctccattaaatactttcacaaagcaacatgggggaggactctaagtcctctgcatcaattagcactcatctgtaagattttccaggtaaggaaagatcaagtgcaaagacccgaaggtgggaaaaaactcagtgtactgggaaacctcagaggcacccagggtggcttctgcaaattaaggaatgaaggaagtaggatgacggaggggctagatctcacataacctacgggaggaatttggattttattttaaagacaatggaaaaccactggtcttttaaggatgacatgatctaatttccatattttaaaagatcattctggctgctgtacagcaaatgggccagaggagaaaaaggagggaggaagggaggcagctgagagtctgaccagtcagtgagctcaagtgatgacagtggctgaagcagggctctgccctgcatggagaagagacgactggggtgcgggaggctggagaagagacgactggggtgcgggaggctggagaagaatgacaactggggtgcgggaggctggagaagaatgacgactggggtgcgggaggctggagaagaatgacgactggggtgcgggaggctggagaagaatgacgactggggtgcgggaggctggagaagaatgacgactggggctgcgggaggctggagaaaaacgacgactgggctgcgggaggcaagagggcggaggaatcaagcatgactgtcaggtttctggcttgtgtaagtggcagacggtgccatgtatgaaaaatggggaaaacctgggaaaaatatatttgggggaatcaagagttttataatagaaatgatacccttgaaatgcttactcaagtggaaatatcaagtaggctattgaatttacaaatctagagctcagaggacagaactggactcaatatagaaaaatgacagttcccagactttagctaattcaaagtgtggcaagggaatgaatgagatcactgcagcaaagtgcaaaaaaggggcctgaggttgagcctcaaggagccctaataatcaaaagtctatagaaagaagagacagcaacaaatttaggagtggcaagtgaggtgaaaagaagagcagaagagacaatagcactgtggaggccaagacagaagtatttcaaggagagagtagtcaattacatccagcactgctgaggagttaagtaatgtgagaacaaaacaagcggcccactgatttggcacttagagatcgctaaagacctcaacaagaaccatttaagtgtagaggtatcagcagaggctctactggagtcaagaataaatggaaagggaaaaagcgtgtagcctagttgcaatgtctatgaaagatgctaagcatggcagcttaaatgatagaaagttgacacttatgtccaatcctaatttatcatcataaggtcacaacaatttttgatttgggatcaaaatcacttactgatccaaagcataagtttcttccagtctcctaagaaggaagttttcccctaatttctaatctcttttcatagctcagatttttttccgcttttctccaaaatacctttcctttagaccaccccatcttctctagcatccgctggccaaacttggaatcgtcattactccaggcagtgttctgaggatccacagcccacttctgcttccgccgacctgtaaatgaaaaagcattatcatcagcaatggagatgatacccggaaaataccacacaaacatacacatgcacaactttgtgtattttatgtatgtatgtaaaatatgacatacattacaatacagaaattaattcaacactcaacagaatgttagactggatcatttatcctgatttccctaataaatgtatattctagacatataagttgacctcttaagattaaaactgaaatgttccctcataatgtggcaaagcaaatgctcaatatactagagctgggccttccatactccgccatcagcacaactgaaagcacctgtggacaccagcatcctcatcaccatcagcagtagtagcagcagcattacagcttccattgccatgcgttactacatacaaaagaacatgcaataccaaggatgcgcttaaaatagtaaatgccaattattcaacctgagacctgctccaaacgctgtacataatattcagttttcacagtaccccaacgagtgtggatagtaccattgtcactggcagatatgaaaatctgaggcttagagaaagaaatttgccgaacatccccaagcaaaaaccagatcctttaaaccaaccttggtcctactaacttcaaagcttatattcttaattcacaacatacaatagtcattatgctcttggggagagtcaactgtaccctccacacatgtgacctacagataataacaatcccatccctctcattgagatgccctgaagccctctgacccctctttgaacttctagaataacttatctgtttcttaacatccactgtattagggctatttatatccgcctttccggtttcccattagaccatcatctccttagggctcatattcatgtcttttttctgaggcttcattgcaagaagtaaaaaaatcactgtgcccacagcaggcactcaataaatatgtgaatggaataaacgataaaaatgaagaatggaaagaggaagaaaggaggaaagaagagggagaggaaaaaaggaaggaaggagtataactgaattaagggaactgctttgaatctcatcaaagcaactttttttaatgcatataaattactgatcattatgaactccagtttatcactgtcgttttaaggaaaattatggcaaaaataaagaactccaaaggttcaaagcacaagaatgtcaaactgaaaagtagactgtggcgaaatgagaaatttggaggtgtcattatcatttatctgccacatcaatataagcacattgtctcaccatcaacacaacccctcctaccttgcccatctcatcacataattaaaaaataacatgaccccctgtcaaaggggctcactgtggcacacataaaatcaatagaggcccataactatgcacactccagcaaaaataggaaatcctttacaaatacacaggcagaaaaaaaggcccttaacaaagcaaaacaagttgggctcgaatttgtagtgttttgcagaaaaaaaaaggtgacccaaaaatgttccatctaaattaccactttacttatcttggcaaatactcagcataacactgcgtctgctaatgaacaacacaccagagagaagcctgttagccagtattctatatgcaagctggcatcagtgtgtcagagttcatgtgtctatgcagtgcttgccaggggtctttgactagggcttgtacgaaggagacagttttgagaataagctcacgctctgcagttaagaactgcacacgcttcacattacctacttatataaaacaaactataatgcctacacaagagattagctattcaaggtcaattcctctcccctgggaaaatggcagttagcttcaatcaatgggatcacaccagtgtttccaaacaaggatgttgggggggcggggggtggcagtttcccattgaaaatgagtaacactgggttaaactaaatttcatatggaagaatctcccggaaactttactatgcaaatgtgcagatcctcttagaggaggccagagcaggcctgccatgcttcccagacttcacttgaccagaaccctgcttccctggaacatttcccagctctaatggcacccaagtttccaggtgtggaaaatcatggtaaggaaaagactgcctctgagctgttccaattggatcaccttttacatgtcctttgtaattctcatgccacagtctgttctgtgctcagatctcagctttgttcactaacacagaaggcctgactgctatcctttgaaaggcctgttcataacagggaactcaagggttcccaccattcgcagaactggtaagagtggctcattgtgcctgtttatgcaaatgatacagtttatgctgagcacctgctttccttctgcgagccaggaattttggtgcctcccaggtagagggtgtctatgtgaccaggccccaggaaatccctagcaccgagtctctcactagcttccctggtgggcaacattccatatttgctctcagaactcactactggaggaattaagcgtgttatgtgtgactccctgggggagggctctggaagcttgacgcctggcttagcctggactttgccccgtgcatcttttccttttgccggctttgctctacatccttttgctgtaataaatcttagcagtgagtgcgactatatgctgagtcctgtgcctgaatcccccagcacatcattgaatctggggatgatcttggggacccttgacacgatctggaacagcagtgtttacagcatggcgctgggcctcagg

SEQ ID NO: 572 - DNA, 77713 bp, Homo sapiens
caaaatatgcaaaaaatgaaatacaagaaaaatttgttggagaaaatttgctatttgagattgagtaaagaatattaatgaagaatgttaaatgaattcccctagattctctgctactataatattaacactataatttaactctataatttaaatatctaaatataatgaaacaactgacatccagagattatgttccattgctggatgagtactcatctgaaagttcttcactgccagaaggtctaggcaacctttccagtagacttagatgataatgtataccattttgaattctaaattccattgaattatctatgtagtcgatagtttttctggaggcattgtccttgcatataaaactagagattaaattcacataattgtgtcagaattgaataaatattttatatgaaagtgttctgcaggaggtcagtttgggcccaagtttttaaagaaggcaaggaatagagagaaaagaatgtattatttaaattaaatagggctatttagctattcaatttccaattattcacctttaagcaatcctattatgctgaaggtcttctgatgcttaccatgtatataatcagattgtgtaaaacactccactgagccatggtctgtttgttgcagcagctttataggcactgaaatgaaaacagtcaagagtagaaaaattatcatgggaactgcagttattcttcacatgtctgagatggtgagaaagctgatatttggcagatatttatttaaagatcaacatattgtgagagcctgaattaaaatagtgttaaaaccaaatttaaaaattacagcattatcacacctatttattacattctgagtattgggtagggtaatggtctaggcattattccagggaagtggaagaaataaactaatgaaattgcaaggctcagaagttaggactgtacactaagtgctagggactcaaaatggaaaatcatgaaaagatttgggattgaagcaatttcaaaataaggatttgacaaataccaaaatgggtctggccattgtttcaattggatgaaatggctccttcctctcagtttagaaaagtattgacatattttaagtcataaaaatccatcaaaacttttctgtgatctcacatcccccagagctatgtctctcttcctctttgtaataaagaatagttcacatttgttttctttgcttgctcaccttctactttctcctcaatccattgcaatctgactctaaattctaccataccactgactaaagtcacaggccgcagttttcagcttactttgccccttaacactactaggtacagttgatcacagatgactgcacaactctgtgcatatactgaaaattattgaatttttattttaaaattggtgttttatggtacaaaaatatacaaaaatgaaatacaataaaaattgttggagaaagtttgccatttgagattgagtaaagaagattaatgaaggttaaatgaattaccctagactctctgctattataatattaactccataatttaaatacctaattgtcttctttctctatgctatcacaccacattcttctcattttcttcctactttacttgtctctcctttgtcccctttgaaagtttctttttctctgcaagtccctcaagtgataatattccttaggattttgtcctattccctcttcttttccaactacacacaacagttatcaccatcttttttttttttttttttttttttttttttgagacggagtctggctctgtcgcccaggctggagtgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcaccgtgtgttagccgggatggtctcaatctcctgacctcatgatccgcccgcttcggcctcccaaagtgctgggattacaggcatgagccaccgcgcccagcccagttatcaccatcttatatcaacctattgtttgtggatttcccccattctatgaatattagtgggataaatataatctactttttagggcaaatgttagcatattttaagatatattaagggtagatttgacatcaaaagcacgggtaacaaaagcaaaaataaacaaatgagactatatccaaaatgcttctgcacagcaaaggaaaaaaatcaacaaaattaagaggcaacctacagaatgggagaaaatatttgtgaactgtgtatctgataaggggctaatatccaaaatatgtaaggaactcacataactcaataacagaaaccccacaaaaaactaataacccaattaaacaatgggcaaaggacttcaaaagacatttttccaaataagatgtaaaatagccaagaggtatatgaaaaatgcacaaaatcagtaatcagaaaaactcaaattaaaaccacaatgagatcacttcacactcattacgatggctattatcaagagacaagtgttggtgaggatgcagagaaaagggagtccttgtacattgctgatgggaatataaattgatacagtctctgtggaaaacagtaaggagtttcctcaaaatattaaaaacagaactaccatatgattcaggaatctcactgctgggtatacatccaaagaaaataaaactagaatctcaaaaagatatctgcattcccatgttccttgcaccatttttcacaatagccaaaataaggaaaccaccttaaagttgacacaagtttatgggtctttgtgacaacatggatgaacctagagggcactaggctaaatgagtaatccaggcacagaaagagaaataccatatgatctcatatgtggaatctagaaaggatgaacttatagaagcagagaatagaatagtgtttgctggggactggagagtgggggaaatggtgagatgccacatatgagatcatatggtatttctctttcagttacaggatgaataagttctgatgatctaatgtacagcatggtagctgcagttaatatttgaaatttggtaagagagcagattataagtgtccttacacacttaaatgcacttaacacacgcacacacaacatggtaactatgatgatgacagacatgttaataaatttgattgtggtaattattgcacaaagtatacatatatcaaatctgtacaccttggatatatacgattttgtttgtcaattatacctcagtaatgctggaaaaaatgtaagggatagctatgttgggttaggtgggacttcaacattttaagtcagtgaagaagggtgtattttgaaattgagacatcacagcttagattattttggatattgccaactgttttggctgcccaaaatattaatccctttctatgaatgcaaaattaccccacctcatgggttttggtgggaagcaaaatatacctcctactacaagggatgaaaattctagatgctaacttgcctaatctccattacagctagggagtggccacataacctaagctccctcaatcagatgtgtctgtgtcagactgagttggaaactaaagatataataagaagatttctctttctggtggcagtggtataatcatttttctaatcagattttcttttttttttttttttttgagacagagtctcactctgtcgccaggctggagtgcagaggtgcgatctcggctcaactgcaacctccgactccctagttcaagcaattctcctgcctcagcctcctgagtagctggcattacaggcacacatcgccacgcccagctaatttttgtatctaatcagagaattctaaggtgtgatttgaggcatttttcttaggtatagctgagccaggttctacattcccttaaacaacttctatgagatctctactgtccttttaataaactccctttctgttcagtcagctaggattggcctctactgcttgcacctaacaaccccaattgatacagctcctaatatttacctctggccctgccctcactctgagatatacgtaagatcatatctcacatatctcacaggttccatacaggatatctcacagtggtttggctctatacctgatatctcacagttatggagccaaaccacttactagctgtgtaatcttgagcacgttacttctttctgaacctttgctcttgtataaaatgagaattatattaatacctacctcacaggaatattgtaatggtcaagtgagaaacttaggtgtcaaaaattgtaaactgaataatgcaatacagtattgtaaaatataatttatactattatagtttattctacattaaatggtagtggtaccttgcttttcttaccaaatgtgtgggaggcttgtaactgtttctttactcctgggaaacaaggtttccccaaagtagctgtatctgcaaacaatgtagagttttatttcttttgacgttgcctctatagtccttgtagagcaccaggagcgaagcactctgttggtaatgatttgaagaaacaaaaataatttgagggttgggaacttgaaagggaggtaaaatagatagcagaacaagaattgatatttctgtaatgcaggcttgagagagacaaaaaagaaactgatgcaaaatactttgaggtctcaaggaaatagaactaaaaagaggatcttacagtaaaaacagtctattcaggctgccatcactgaagcaaatgaatcaggatattgttaacgtttttgtcactttgcttgagatgcatcatggaagaaatatgtactggattggcctgacttggctagcacacctgttctttgcctaggagagggcctggttcctttagaccatatccaaaagagataattctctacaaagaaattgagggtatagggatgacagaaaaatagatgctgacagcaacaacaaatgcacatgattgtgaaatggaaaaagtaatcttgtttttttctaccatgtcatactgccaggctttagtaccatgccaggttgagaattgttttttggtgcagagagactggcatcataatttattttccttagaaagcaatgccacagcacctccaaggttacgggcaaatatcaaataatgatgagtgttgggtttttgtcttctgaaatgagtaaaacaagttctcgtagttttttgtacttgaaaaagtacagtacaatttttatttatgaatgttttaaaaattgccaattttctccaagttcctaatagctcaatttttttactgctctaaatatagagtttacaatgtgttgttttagatttttggtaaccatacatatttagcaattaaagatattagtgctaccaagcgactttgaaaaatactgattactaaaataaaaaagaaatattttgagttttagtgcttaattccttctgttggttatagaagaagtaattgaaatgtagttgaaggagctagattggaggtatctgctatgctctatcactaggacagaatttctcaacctcaggggccatttggggccaaataactcttagttacagggtgttgttctgtgcattgtaggatgtttagagtcatttctggactctacctactagatgcctatagcattccctacccctcagttgtgacagtcacatatatctccagacatagccaacgatttggggagggtgtataaaatcactgctggttcagaactactagactagaggtaaagctacaaaatcctgtgcattgagaaaatcatttatgaagatttcctctttatactgaggttgaggcaaatcaataagggttattcaaaactttgtggcctaagcattcaagagatttgtatcctacagatcatgaatataccagaagcaggaactaatacaatgcaataacaattacagggcagcattgccaaaaatgagaaggatttaggccacagacagaaattacatcactgagaattccatacagacccgtatatgatagctaatgctgaagcacactccagcaataatgctgtgatatagtgttgcattattaactgaaaataagtgagtataactgggttttccaatggaattcttaagaatgttaattttttctgtggaacacactttaggatgagctggactgggaagaagctactgagtttgcacacttgagaaccaagcagtattttctaccacactgtcttgggaaacagcccagaaatacatatcaggtgtagctttcaaaaacaacatttctttggccatgaactagctgagcaagattatattcttactcataatataattttaactagttaagaatgtgtatatcattatacaccaagacaaagctagtctcattacattgcccatatattgaatatcatggtgatctggacaatatcagtctgttatttaaagctcagtaaaccactaacattaaacaaataatttgaaaaactttattgcaggtcttgcatgtctcccatttccaacatacttgtgactggtccatttttattcattacatcacatttctgttttcctctaagaatttgccataacttgcagagaaaattgccaggacagatctatttctgcgctgaagcctcatcatgccattctcacacattttcttgatttggtagttctctaggaaacaaggctgatactttagcttccctttcaaattcaatactatattccaacatgtatatttttaagctgtctggaagcattgaaagtttaaatttccttaaaatgaggataaatctatcatagagtcagttgaacttccagaaatcaattttcagaaggattacaatccaaaaaattacaaaatgagatattacagtgaaagtggctcttacttttgggtagatttcagatctttctctaattataaaatacaaaatactggaggagccaagatggccgaacaggaacagctccggtctacagctcccagcgtgagtgacgcagaagacgggtgatttctgcatttccatttgaggtaccgggttcatctcactagggagtgccagacagtgggcgcaggacagtgggtgcagcgcaccatgcgccagccgaagcagggcgaggcattgcctcactcgggaagcgcaagggatcagggagttccctttcctggtcaaggaaaggggtgacagacggcacttggaaaatcgggccactcccacccaaatactgcgcttttctgacgggcttaaaaaacggcgcaccaggagattatatcccgcacatggctcggagggtcctatgcccacggagtctcgctgattgctagcatagcagtctgagatcaaactgcaaggtggcagcgaggctgggggaggggcgcccgccattgcccaggcttgcttaggtaaacaaagcagccgggaagctcgaactcggtggagcccaccacagctcaaggaggcctgcctccctctgtaggctccacctctaggggcagggcacagacacacaaaaagacagcagtaacctctgcagacttaaatgtccctgtctgacagctttgaagagagcagtggttctcccagaacgcagctggagatctgagaacgggcagactgcctcctcaagtgggtccctgacccctgacccccgagcagcctaactgggaggcatcccccagtaggggcagactgacacctcacacggccgggtactcctctgagacaaaacttccagaggaacgatcagatagcagcattcgcggttcacgaaaatccgctgttctgcagacaccgctgctgatacccaggcaaacagggtctggagtggacctctaacaaactccaacagacctgcagctgagggtcctgtctgttagaaggaaaactaacaaacagaaaggacatccacaccaaaaacgcatctgtacatcaccatcatcaaagaccaaaagtagataaaaccacaaagatggggaaaaaacagagcagaaaaactggaaactctaaaaggcagagcgcctctcctcctccaaaggaacgcagttcctcaccagcaacggaacaaagctggacggagaatgactttgacgagttgagagaagaaggcttcagatgatcaaactactccgagctacaggaggaaattcaaaccaaaggcaaagaaggtaaaaactttgaaaaaaatttagatgaatgtataactagaatacccaatacagagaagtgcttaaaggagctgacggagctgaaagccaaggctcaagaactacatgaagaatgcagaagcctcaggagccgatgcgatcacctggaagaaagggtatcagtgatggaagatgaaatgaatgaaatgaagcgagaagggaagtttagagaaaaaagaataaaaagaaatgaacagagcctccaagaaatatgggactatgtgaaaagaccaaatctacatcgtattggtatacctgaaagtgatgcggagaatggaaccaagttggaaaacactctgcaggatattatccaggagaacttccccaatctagcaaggcaggccaacattcagattcaggaaacacagagaatgtcacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctataagccagaagagagtgggggccaatattcaacattcttaaaggaaagaattttcaacccggaatttcatatccagccaaaccaagcttcatgagtgaaggagaaataaaatcctttacagacaagcaaatgctgagagattttatcaccaccaggcctgtcctaaaagagctcctgaaggaagcactaaacatggtaaggaacaaccgataccagccaccgcaaaatcatgccaaattgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggaaaaagagtcaagacccatcagtgtgctgtattcaggaaacccatctcacgtgcagagacacacaaaggctcaaaataaaaggttggaggaagatctaccaagcaaatgggaaacaaaaaaaggcaggggttgcaatcctagtctctgataaaacagactttaaaccaacaaagatcaaaagagacaaagaaggccattacataatggtaaaggggtcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatatccaggaattgaactcggctctgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattgtaacaaactgtctctcagaccacagtgcaatcaaactagaactcaggattaagaaactcactcaaaaccgctcaactacatggaaactgaacaacctgctcctgaatgactactgggtacataacaaaatgaaggcagaaataaagatgttctttgaaaccaatgagaacaaagacacaacataccagaatctctgggacacattcaaagcagtgtgtagaggggaatttataggactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaattaatgaatccaggaggtggttttttgaaagggtcaacaaaattgatagaccgctagcaagactaataaagaagaaaagagagaagaatcaaatagacgcaataaaaaatgataaaggggatatcaccatcgatcccacagaaatacaaactaccatgagagaatactataaatacctctacacaaataaactagaaaatctagaagaaatggataaattcctcgacacatacaccctcccaagactaaaccaggaagaagttgaatctctgaatagaccaataacgggctctgaaattgtggcaataatcaatagcttaccaaccaaaaagagtccaggaccagatggattcacagccgaattctaccagaggtacaaggaggaattggtaccattccttctgaaactattccaatcaatagaaaaagacggagtcctccctaactcattttatgaggccagcatcatcctgataccaaagccgggcagagacacaaccaaaaaagggaattttagaccagtatccttgatgaacattgatgcaaaaatcctcaataaaatactggcaaactgaatccagcagcacatcaaaaagcttatccaccatgatcaagtgggcttcatccctgggatgcaaggctggttcaatatacacaaataaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactaaatgggcaaaagctggaagcattccctttgaaaactggcacaagacagggatgccctctctcaccactcctattcaacatagtgttggaagttctggccagggaaattaggcaggagaaggaaataaagggtattcgattaggaaaagaggaagtcaaattgtccctgtgtgcagacgacatgattgtagatctagaaaaccccattgtctcagccccaaatgtccttaagctgataagcaacttctgcaaagtctcaggatacaaatcaatgtacaaaaatcacaagcattcttatacaccaataacagacagagagccaaatcatgagtgaactcccattcacaactgcttcaaagagaataaaatagctaggaatccaacttacaagagacgtgaagtacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaacaatgactttcttcacagaattggaaaaaactactttaaagttcatatggaaccaaaaaagagcccacatcaccaagtcaatcctaagccaaaagaacaaacctggaggcatcacgctacctgacttcaaactatactacaaggctacagtaacaaaaacagcatggtactggtaccaaaacagagatatagatcaatggaacagaacacagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaacatcagagtgaacaggcaacctacagatgggagaaaatttttgcaatctactcatctgacaaagggctaatatccagaatctacaaagaactcaaacaaatttacaagaaaaaaaacaaacaaccccatcaaaaagtgggtgaaggatatgaacagacacttctcaaaagaagacatttatgcagccaacagacacatgaaaaaatgctcttcatcactggtcatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatacacccaaaggactataaatcatgctgctatcaagacacatgcacacgtatgtttattgtggcactattcacaatagcaaagacttggaaccaacccaaatgtccaataatgctagactggattaagaaaatgtggcacatatacaccatggaatactatgcagccataaaaaatgatgagttcacgtcctttgtaggggcatggatgaaattggaaatcatcattctcagtaaactatcgcaaggacaaaaaaccaaacaccgcatgttctcactcatagatgggaattgaacaataagaacacatggatacaggaaggggaacatcacactctggggactgttgtggggtgggggaggggggagggatagcattaggagatatacctaatgctaaatgacgagttaatgggtgcagcacaccaacatggcacatgtatacatatgtaactaacctgcacactgtaccctaaaacttaaagtataataataataataaataaataaataaataaataaataataaaaagtaaaaaaaaatacaaaatacctctgtaaccaagaggtattttgtgtctgtgggttatacagcttaaggtattatgcattgatttaaaaattaataaacatgaaaacacagatatagcacttagaaatgagtccaaaactatgcaggactacaatcctttttgataaatcccctcttaattgtaaatacctctgtgaaacttgcctggtctacacttataagacacaagaagctacttatatgtctcaggacatgggtctggtccaaatactcaactattcacagatatcagataccagttttggtcctggcactcatccatgagtttcttatgaagagaagagaagagaagagaagaggagattacgaaataaaaatgtgatgtacaccttaatgtgttatcatttccatcaatgaattttacaacttttcaataaaatgtttctttttactctgatatctagaagttctattcaatgaacactgaaaagatatagacagattcatgatagctagatagatacattagacatgaaaaattaaaaccgtgaattatagctctgtcatttacttgctctatgactattaaaaaattatatccacaaaattttatttctttatgtttcatggagatagtaattcccagcacaagttaagcaaaaaactatgttcaaattcaattactacagaaatcaaagcttttactatatggacaagctgagtactctggctctggaaatgattaggaataacacacaggccaataatatttgtggctcattaaaatgggagagggcacactgaatggcaagaagaaaatcaagagacatggaaccatggaagccaagggaattgagtgtttaaaaaaaggtagactggtaggctgtgtcaaataatcctaaggagttagatcagataaagacatcaaagtgtccatcagatttaacaacatggacatcattaatgacctcagtgaagctggtggtgtcagaaataagactgagtgaatttctattgagaaagtaaagatggagagtgtgtttttttaaacagaataagacaaaataaaggccagtcagaaagctatatatttagtttctattacagactgatctaccagctttccaactggtagatcccttagtccagctcccatctaggtcattaatggcctctgtcacttactagctatggagctatagaagaatcagttcacccacctgattctgtttcctcatccttaaaatggtttaaaaaatagtaactacttcatagagttattatgtagattaatggctagaatgcttatgctgtgccaagcaacatacctggcacatagtagctgtttaataaacatcagctagtattataagaaaggaaagaaattggccaaattaagatcatgtaactaagatcaaaattctcctgatccaaatggtgtaggaaaaccatctaggactaatttctttattttttattttatttaccttgtcctggtagttacatatccaatctgttcctttctcagataaaatcagtgtgttttacttttgaatgtagagttatcgataaccttactctctgagaagttgcatcttacctgtctagttgtgactgacacacagttggcattttcactggtcctaccaattggagttgggcaaaagttttccttggagactttatgaccataaaaagtggaagtgatttctgccttcatttcgttatgtacctagtagtcattcaggagcaggttgttcagtttccatgtagttgagcggttttgagtgagtttcttaatcctgaattctagtttgattgcactgtggtctgagagacagtttgttataatttctgttcttttatatttgctgaggagtgctttacttccaactatgtggtcaattttggaataagtgtgatgtggtgctgagaagaaagtatattctgttgatttggggtggagagttctgtagatgtctattaggtccgcttggtgcagagctgagttcaattcctggatatccttgttaactttctgccttgttgatctgtctaatgttgacagtggggtgttaaagtctcccattattattgtgtgggagtctaagtctctttgtaggtctctaaggacttgttttatgaatctgggtgctcctgtattgggtgcatatatatttaggatagttagctcttcttgttgaattgatccctttaccattatgtaatggccttctttgtctcttttgatctttgttgatttaaagtctgttttatcagagactaggattgcaacccctgcctttcttcatttttctttgaaaccaatgagaacaaagacacaacatacgagaatctctgggacacatttaaagcagtgcatagaaggaaatttatagcactaaatgcccataagagaaagcaggaaagatccaaaattgacaccctaacatcacaattaaaagaaccagagaagcaagagcaaacattcaaaagctagcagaaggcaagaaataactaagatcagagcacaactgaaggagatagagacacaaaaacgcttcaaaaaatcaatgaatccaggagctggtttttcaaaaagatcaacaaaactgagagactgctagcaaaactaataaagaagaaaagagagaagaatcaaatagacgcaataaaaaacgataaaggggatatcaccaccattcccacagaaatacaaactaccatcagagaatactataaatacctctacacaaataaactagaaaatctagaagaaatggataaattcctggatacacataccctcccaagactaaaccaggaagaagttgaatctctgaatagaccaataacaggctctgaaattgaggcaataattaatagcttacaaccaaaaaaagtccaggaccagacggattcacagccaaattctgccagaggtacaaggaggagctggaaccattccttctgaaactattccaatcaatagagaaagagggaatcctccctaactcactttatgaagccagcatcatactgataccaaagcctggcagagacacaacaaaaaaagagaattttagaccaatatccctgaagaacattgatgcaaaaatcctcaataaaatactggcaaaccgaatccagcagcacatcaaaaagcttatccaccatgatcaagtgggcttcatccctcggatgcaaggctggttcaacacacgcaaatcaataaacataatccagcatataaacagaaccaaagacaaaaaccacatgattatctcaatagatgcagaaaaggtctttgacaaaattcaacagccttcatgctaaaaactctcaataaattaggtattgatgggatggatctcaaaataataagagctatctatgacaaacccacaaccaatatcatactgaatgggcaaaaactggaagcattcccttcgaaaactggcacaagacagggatgccctctctcaccactcctattcaacatagtgttggaagttctggccagggcaatcaggcaggaggaagaaataaagggtattcaattaggaaaagaggaagtcaaattgtccctgtttgcagatgacatgattgtatatttagaaaaccccatcatcacagcccaaaatctccttaagctgataagcaacttctgcaaagcctcaggatacaaaatcaatgtgcaaaaatcacaagcattcttatacaccaataacagacagagagccaaatcatgagtgagctcccattcataattgcttcaaagagaataaaatagctaggaatccaacttacaagggatgtgaaggacctcttcaaggagaactacaaaccactgctcaaggaaataaaagaggacacaaacaaatggaagaacattccatgctcatggatagaagaatcaatatcatgaaaatggccatactccccaaggtaatttatagattcaatgccatccccatcaagctaacaatgactttcttcacagaattggaaaaaactactttaaagttcatatggaaccaaaaaagagcccatatcgcgaagttaatcctaagccaaaagaataaacctggaggcatcacgctacctgacttcaaactatactacaaggctacagtaaccaaaacagcatggtactggtaccaaaacagagatatagaccaagggaacagaacacagccctcagaaataataccacacatctataaccatctgatctttgacaaacctgacaaaaacaagaaatgaggaaaggattccctatttaataaatggtgctgggaaaattggctagccatatggagaaagccgaaactggatcccttccttacaccttatacaaaaattaattcaagatggattaaagatttaaatgttagacctaaaaccataaaaaccctagaagaaaacctaggcaataccattcaggacataggcatggcgaaggacttcttgactaaaacaccaaaagcaatggcaacaaaagccaaaattgacaaatgggatctaattcaactaaagagcttctgcacagcaaaagaaactaccatcagagtgaacaggcaacctacagatgggagaaaatttttgcaatctactcatctgacaaagggctaatatccagaatctacaaagaactcaaacaaatttacaagaaaaaaaacaaacaaccccatcaaaaagtgggtgaaggatatgaacagacacttctcaaaagaagacatttatgcagccaacagacacatgaaaaaatgctcatcatcactggtcatcagagaaatgcaaatcaaaatcacaatgagataccgtctcacaccagttagaatggcgatcattaaaaagtcaggaaacaacaggtgctggagagggtgtggagaaataggaacacttttacactgttggtgggactgtaaactagttcaaccattgtggaagtcagtgtggcgattcctcagggatccagaactagaaataccatttgacccagccatccctttactgggtatatacccaaaggattataaatcatgctgctataaagacatatgcacacgtatgttcattgcagcactattcacaatagcaaagacttggaaccaacccaaatgtccaacaacgatagactggattaagaaaatgtgccacatatacaccatggaatactatgcagccataaaaaaggatgagttcatgtcctttgtagggacgtggatgaagctggaaaccatcattctgagcaaactatcacaaggacaaaaaaccaagtaccgtaggttctcactcataggtgggaattgaacaatgagaacacttggacacaggaaggtgaacatcacacactggggcctgtcacgtggcgggggtaggggggagggatagcattaggagatatacgtaatgtaaatgaagagttaatgggtgcagcacaccaacatggcacatgtatacatatgtaacaaacctgcacgttgtgcacatgtaccctagaacttaaagtataataatcataaaaaaaagcggaagggataataatagatgccttttgtgggtacatgattcccagttgctctccatagcattcatgagctatatgtttcttcaggaccttctttagttaggctgggggaatgttggaggtagataatggagaagaatactgtataactcccaaagtactcctagactcttataaaggacctcaaatttcaaccctgctaaatccccatacagtgcctaagtatcttttatagattcccagtaatcagtcatctagaatcttcctaaacacttttaataatagggtatatttgttatgtggctgttgaatagttatattggttaaatgtgtttcctcatgttgaatgaattcctggtctcccttttgcaacttctgcctattaattctacttccatcactaggagttattaaaaaaactaggtctgagtcctctttttcataatactctattagatatttaaggacagtgactttcttgcactacaaaacaaattttctcaacctaagttgagaaacttcctaatttccaaacttctcaccatactttaaaatcgcatatgaaccatgtctagcttgacaataaatttcttaaagtattagaaacaacaccagatagagtctgaatgaaatagagaacaatgtgatttctagaagtcaccttttacttctagtttgaaaacaagcacactatactattattgcctatcttatgagactgtgtcagacactttattgactacccagtatttatttctatctttctttactaataggaggcttaattttgtttgtggtaataatgtactcagccccagttgagacacttgctttttcaggctctttttaagctagagcagccgtgtgacacagatacctaccttttgcatgccatgatatcgcaaaggttactataaatccttatcttttgcttctgcctctcctcttccctccaagtgaatctactaatattcctctttcttcctgaacttctactagcaaaatccattctacccaaatttctcatccaattctgacagaggaagtatataggcagcctactattctaagcttattgcaaggcttatctcgtttaatcctcaaaaataccctatgagctcagtaaaattattatccacatttttcaaaagaaaagcaatgaggatcagaaaggtgaagatactagagagtaagtagtaaagctagtatttaaacatagttcaacatgtttttaacccctgccctgaggtcctcttactaagagtcctttgtcagaggggccaagatggctaattagaagcagctgtggcccgccgcactcagaggaatgaaagaggcaagtgaatacagcaccttcaactgaaatatccaggttcttgcactgggactgattaggacagctcgacccacggagcatgaagataagcagggtggggaaatggctcactcaggagcgacactcagccaagggaacgcccaaacccagccaagggaagcagtgagtgattgtgcaacccctggaaaccacgctcttcccatgtatctttgtaatttgctgatcaggagatccccttgtgagcccaccagggccttggggctgacacacagagttgtctggagtcttggcagagcagatgctcaggcacacaaagagacccagtagcattacatactccagccccgggatccccaacatagatgtctgcaactcatgcagggcaagagagctgcacatacccctaggaagggggtggaacccagggagccaagcagcattgttctgtgggccacactttcatggcacctcacaagataagacccactggcttggaattccagccagctaccagcaacaaggtggagcctgcctaaggctggacagagccccctgtgggcagggggaggggtgggcaccatctctgctctttggtcaactcagctgttccagcctgcaggctttggagaatccaaatggtccagacaggaagggtccctccgttgccatattgtggccaaactgcttctttaagtgggcccaatccattcctcctcactgggcagaacctcccagctgggacttctggccatgcctgcttgcacatattatggacagagctctgaactatctctaggatggagtgccctgaggaggggagggctgccacctgggttggttggacgactcagccgttccagcctgcaagctttggaaagtccaagccaatggggacagaggtggttccccaccatgacacagctgttttgttgaggtgtggccagactgcttctttaagtgggaccccaatccactcctcctcatggggcagatcctcccagcagggtcctccaagccagggcctctggccacccccacccatgttctatagggccaacagagctctaatttctccctgagacagagtgcctgaggggcaaggcaggtcaccacctgagacattcgggcttcttagccagtccagcttctgggccgtggaaagcccaaaccagacgggggctgaaaggatccccaacacagcacagctgctctgccacaaagcagccagactgctcctttaactgggtccctgatcctgttcctcctgactgagtgagaacctccaaatgaggtctctagccacctcctacagacctgttggagccagcaataaatcagtagccctctgggatggagcttccagagaaaggggcagactgccatctttgctgttttgcagtcttcactggtgacacctccaggtgtgggaataactgaggcaagtagggtctggagtgaacccccagcaaatagcagcagccctacagaagactggctagaccattaaaagaaaagcaaacagaaaacaacaacaacaacaaaaaaagtcccccacaaagtccccatccaaaggtcagcaacctcaaagattgaaggtagtaagcccccaaagatgagaaagaatcaatacaaaaatgcagaaaactcaaaaagtcagagtgccccttttcctccaaatgactgcagtgcctctccagcaagggctcagaactggactgaggctgggatggctgaaatgacagaagtaagcttcagaaggtgggtaataatgaactttgctgagctaaaggagcatgttgtaacccaatgcaaagagataagaattaagataaaacaatacaggagctgatagccaaattagtcagcatagagaggaacataactgacctattagaactgaaaaacacactacaagaacttcacaatgcaatcacaagtattaatagcagaatagaccaagcagattattctcagagcttgaagactatttttttctgaaataaggcagggagacaagaatagagaaaaaagaatgaaaaggaataaacaaaacctttgagaaatgggattatgtaaagagaccaaacctttgactgattggggtacctgaaagagatgaggagaatagaaccaagttggaaaacatacttcaggatatcatccaggaaaaattccccaacctagcaagacaggccaacattcaaattcagaaaatgcagagaaccccattaagatacttcatgagaagatcatccccacgacaataatcatcagattcttcaaggttgcaatgcaagaaaaaatgttaagggcagctagagagaaaatccaggtcacctacaaagggaagcccttcagactaacagcagacttctcagtggaaagcccataagccaggagattaggggacaatattcaacattcttaaagaaagaatttccatcccagaatttcctatccagccaaactaagcttcataagcaaagaaataagatcttttttggacaagcaaatgctgagggaatttgttaccaccagatctgccttacaagagctccagaaggaagtactaaatatggaaaggaaagaccattaccagtcactccaaaaccacattgaagtacacagaccagtgacactataaagcaaccatgtaaacaagtctacaaaataactagctaacatcataatgacaggataaaatccacacataacaatactaaccttaaatgtaaatgggctaaatgtcccaattaaatgatacagaatggcaagctggttaaagaaccaagacccactggtatgcggtcttcaagagaaccatctcacatgcaataacacacataggctcaaaataaagggatggaggaaaatttaccaagcaaatggaaaatagaaaaaggcagtggttgcaattctactttctgacaaaacagactttaaaccaacaaaaatcaaaaaagaaaaagaagggcattacataatggtaaaaggttcaattcaacaagaagagctaactatcctaaatatatatgcaccccatataggagcactgagattcataaagcaagttcttagagacattcaaagagacttagactcccacacaataatagtaggagactgtaacatcccactgacaatactagacagatcattgaaacagaaaattaacaaagtattcaggaccttaactcagctctggatcaagtggacttgatagatatttatagaactctccacccaaaaacaacagaaaatacattcttcccatcaccacatgtcacttactctaaaatcgaccacataaagtaaaacactcctcagcaaatgcaaaagaactgaaatcatagcagtctggtatctcccctctcacccatgcttcctctcttgtcatgtgatctcttgcaccaattggctccccttccccttccacaatgaatggaagcagcctcaggccccccgcagaagcagttgttggcaacttgcttcttgtacagcttgcagaaccatgaaccaaagaaacatctttctttgtaaattaccaagcctcaagtattcctttatagtaacactaaatggactaagacaagtaacaataagatggaagagctaaaaaacacaatggactttcaacagggccatactaacaagatataaaacacagcctaaacaagttacaggtgattaaacagtaagtgaacagattactagaacaaaagtcaacattaatagaggaagataatagaatgcagattctctacgatattatacaccatgttcagaaaagaaaatgtgacacaaaaaaagcaatcactaggaatcaaccaaaagatgctccagatgttaaatttaaaagaaaacaatgataaagtagttagtataaatagtttaaataaaaaaggagagatgatatcaggaagacagcaagctaggcggtgctaaccttcatcctctcacaaaaacaacaatttaacaactattcatggatgaaaatagctctgggacagttctgggctacaactaaaaaggaacagtagccgagtggagcacaaaaatcaaggatggctgcatagaaaaaggtaggaaatattttacctctggctggaaaagcttagttccaagaggaatctccttggctatgagttcccactgcagagaataagaagaacaggaggaccccagcaatctttgccattgaggaccccagaagcccttgtgaccatcacggacccctaaacagccttctgctggagaggacccctgcagtctttgcaaatgtaaaactcagttgatggagcctcctggatctcaagttactgtggctcccaaagccagagaaaccaaatccccctcacctggatgatgcaactgtgggcccctcaaagccagtgccactgcgctcccccagccagttgccaaaaagtgcatgtgccccagacctagtgctactgcccacttgacccagatggtgccctcatactcgttcacaggtgaaggcttttccctatagtaaccagtccataaagtctggaagaagtgaccttttttaatgcacagacactgggttgggcagggtcttcaagacggctgattagaggtatctcctactcaccttgtccactaagaagaaccaaaatagcaggtagataactacacctcaagtagatcatccaagagaggacactggaattcaatagtgaaatgacaggaaacaaagcaaggaaagggagggaagtgaggcagcctgcttggccaggattggctgggagctgagacagactccccaatgcatggaaaacgtgagagaccatcagcagtccacattcccattatgaactcctgaaatcctagtttgagagagccccttaaccctccttggccctgagactaacatggtgagctctctggaaatcacaagaaggaactgcaccagagagaggactcactctgggtaccacaagctcccacgtccttggcaacagtgacacagtaccatctttagagcacagtccacaccggactatgtggtgccctgcatccagcaccaaggtagtagccataggcagcaggcagcaatcctttcccctcacctcctgcaaaggggtggccatgtattttaacatgccccaaggacaaattccactgcctgctattgcagtggctgcagactgctgtgagctgatgcattagtgtgtactcacgctgctatgaagaaatacctcagactgggtaatttataaagaaatgagaactaattgactcacagttccacaggcttggggaggcctcaggaaacttacaactagggtagaaggggaggcaaacacatccttcttcacagggtggcagcaaggagaagaatgagagctgagtgaagcagggaagccctttataaaaccatcagatatcaagagaacttactcactataacgagaacaggatgggggaaaccacacccatgattccattatctccccctggtccctcccatgacacatggggattatgggaactacaattcaagatgagatttgggtggctacacagccaaaccatatcactgtacccctggcccctcccaaaattcaagtcttcacatttcaaaatgtaatcatgctttcccaacagtcccccaaagtcttaacttattccagcattaacccaaaagtccaagtccaaagtctcatctgagacaagaatgtcccttctacctgagcctgtaaaatcaaaagcaagttagttacttcctagatacaatggggatacaggcattgggtaaatatatccaatccaaatgggttaaattggccaaaatgaagaggctacagtccccatgaaagcatgaaatccaatggggcagtctgtcttgaagctccaaaatgatctcctttgactccatgtgtcacatccaggtcacactgatgcaagaggtgagctcccacaaccttgagcagctccacccctgtggctttgcagggtacagcccccttcctggctgctttcatggctggcgttgagtatttgcagcttcttcaggcgcatggtgcaagctttcagtggatctaccattctgtggtctggatgatggtagccttcttctcacagctccattaggcagtgccccagtggggactctgtatgggggctcacaccccacatttcccttctgcactgctttagcagaggttctccataagggctctgcccctgcagcagacctctacctgaacaccacaacttgaggctgcatagagcaggaaggccctggacctggcccaggaaaccattttttcctcctaggccactgggcctgtgatgggagagatgatttagggtatctggtgaaagaaatttttaagtggcaaagcattgaagaggaagcagagcataaatatttgaaaaatttgcagcctagtgattcaatagaaaagaaaatcccattttctgcagagaaattctcagcatcccactctaccagtaccaatttactgtattagtccattctcacactgctatgaagaaatacctgagactgggtaatttataaagaaaagaggcttaactgacttactgttctgctggttagggaggcctcaggaaaattacaatcatggtggaaggagaagcaaacacgtccttcttcacatggcagcaggaaggagaagaagaatgacagccaagtgaagggggaagcccattgtaaaaccatcagatctcatgagaacttactatcatgagaacaggatgcgggtaacaggccccatgattcaatgatctccacctggtccctcccgtaatgcatggggtttgtgagaaatacaaatcatgatgagatttgggtggggacacagacaaaccatatcagatgatgtgtaggcaaagccaactacctatggctgctcccagggaaagcaattccaccttcttaagtaacttagtaacagcacagccattgccgccttcacctgagcattctgttgatgacctatggctcacttcacccctacataacacagtcagcatcttcatgaagcatgatgggggtggtgtgaaaccacagctcagccaggctccacctcatgcccaagatccaagcatatcagtcagaggcccagggattgaccagcccagttcaccaccagtagcacctgagcactcctcccagggtctgacatcaggcccactcaacctgctgttaccaccaaagctggtgcccacccccatgcatcaccttccagtctgggcactggcctccccaacccatcacagccactgccaacaccagcatgagcctaacatagctactggatagccctaccatagctactgccatcacccacatcatgcaggctgtccagggccttaaggactgacccacatgctcagcccatcaatgtcattcctggcacctgaacaagccacctggaggcttaagagtcagccttagaggacccattaacactggcaccaatgtgtgccaacctaaaacccagggacagatttgcccatcccaccattgatgacattgggacccaaaaactggcctacctggcatcccagtcaccagcaaaatttcaccccagcctccagtagtagccacaacctaagccactgaggaaatcagttatcactgatgctgtttacagccaagcaagtcatgcaaagactacactactccccatactccaaagttaaagcactctcctatgatagcaatgtttttaattggaaaaagtgactgttacatcagatgtatggatatcagcgtaaggacaaaagaaacattaaaaagaaatatgacacctacaaagggacacaataattctccagcaacagatcccaattaaaaaaagcataaggccaggcacggtggctcatgcctgcaatccaagcactttgggatgccaaggcaggtggatcacttgaggtcaggagttcatgaacagcctggccaacatggcgaaaccacatctctactaaaaataaaaaaaaaatagctgtgtatggtgacacatgcatataatcccaggtactcaggaggctgaggcaggagaatcacttgaacctgggaggcgaaggttgcagtgagctgagtttgcaccactgcactccagcctgggtgacagggtgagactccatctcaaaaaaaaagaaaaaagaaaaaagaaagcatgaaaccccccaaaattcaaaatttcaatactaaaaattcttagtgatatataagagaattccagaaaacaataggaagaaataagaaaaacaattcaggatacaaatgagaaatttaccaaatagatagatataataaaaacaaaccaaacagaaatcctggagtaaagaattcattgtgagaaatacacactggattcaaaagttacaacaatagactgtatcaagcagatgaaaatctcagaacttgatgacaagtttttttgaaataacccagtcagacaagagtatagaaaaaacaataaaaaagaataagcaaatccttcatgacataagggacaccataggtgacaaatctttgaattatcacagttccaatagacaaagagagaatgaaagggtaagaaaacctattaaacaaaataatagatacaaatttcccaagtaaagagatgtaaacatccagatgcaggaagccgagagactgccaaacagatacaatgcaaaaagctcttctccacagtgcactgtagttaaactgtcaaaagtcaaagacaaagagagaattctaaaattagcaagagaaaagcatctagtcacttataaaggaatccccattagactaacagcagatttctcagcagaaaccttataaacaggagagaattggatgatatattcaaagtgcagaaagaaaaaaattgtcagctaaggacattaaacctaacaaagttatcctttataaataaagcagaaataaactattttccagaaaaacaatagctgagagaatttatcaccgctagaatggctctacaaaaaatacttaagggagtcctacacatggaagcaaaagcatgatatctactatcatgaaaacatatgaaagtataaaacccattaatagagcaaacctacaaataaagaagagaatggaataaaatattatcactatagaaaaccaccaaaccacaatgataaacaataagagagaaagaaaggaatgaagaatattaaaaacaaccagaaaacaatgaacaatatgacaagaacaaaacctcacatatccataataaccttaaatgtgaatggattaaattctccacttaaaatgcatagaatggttaaacgaataaaaacatggcccaagtatatgttgcctacaagaaatgcactttgcctgtaaagacatatatagactgaaagtatagggatagaaaaatatatttcacacaaacagaaagtaaaaataagcaggagtagttagaaaaaacagactttaagtcaaaatagtaaaaaaaaaaaacaatattattatatcatgataaagagatcaatccatggagagtatgtaacaattataaatatacatgtacccgatattggagaactcagattcttgaagcaaatattactagatctaaagagaatggctcaatataataatagtgagggatttcaacaccctactcttagacagatcatctaaagcactggatttatttatttatttattttgaggctgggttataagactggcaaatttttgtatttttggtagagacagggttttaccatgttgcccaggctggcactgagctcctgggctcaagtgatccacctgccttggcctcccaaagtgctgggattacaggtgtgagccaccatgcctggctgaaacattggatttaaatcaggctttaaaccaaatggatctaacagacatttacaaaatatgtcatccaatagttgtagaatacacattcttctcaaaagcacatggaacattctatagaataggcaatatgttaggacacaaaacaagtcttaaactttaaaataccgaagtcatatcaagcatcttgtcagatcacagtggaaaaaattagaaatcaatacaaaacagctttggaaaccacacgaatacatggaaattaaacaacatgcttcagaaagaccattgggtcaatgaagaagttaagatgggaattaaaaatcattgaaacaaatgaaaataaaaatacaacataccaaaacctatgggatacagcaaaagcagtgataagagggaagtttacagcaataaatgcctatatcaaaaaagtagaaagatttaaaatattaaatctttaaaattttaaataaacttttaaagttaaaaaaatctaacaatgtaccttaaggaactagaaaagcagcaacaaaccaaatccaaaattagcagaaggaaagaaataataaagatcagagcagaactacacaaaatagaggaaaaaaatacagtgcatcaatggaacaaacagtaagttttttgaaaagataaacaaaattgataaattgcaagcgagactaaccaagaaaagaagggagaacacaaacattaacaaaattagaaatggaaaagaagacattacaagtgatactacaaaaatgcaaggggtcatcagggattattacgaaaactatatactaacaacaagaaaacctagaggaactggataaatttctggaagcatacaacctaacaagattgaatcaggaagaaatagaaaacctagatggaaaaataatgagtagtgagattgaattaataattaaatgtctcccaacaaagaaaagtccaggactggattcactgctaaattctaccaaacatataaagaagaactaatgccaacacttctcaaactattccaaaaagttcaaggtataagaatacttcctgactcatcctatgagaccagcattactctaataacaaaatcagaaaatgacacaataaatttagaaaagtacaggtcaatattcctaatgaacatagacacagaaattctccacaagatactaggaaaccaaatccaacagcacatcaaaaaatgaatacaccatgattaagtataatttataccagggatgcaaggatgtttcaacatatgcaaatcattgaatgtcatgaatcacatcaaaagaataagaaacaaaaagcatatggtcatctcaatagatgcagaaaaagcatttgataaaattcaatatcatttcatgattaaaaactcgacaaactaggcatagaaggaacctttattatttcaaaataataaaggccatatatgacaaacccacagctagaatcatactgaatggggaaaatttgaaagccttccctcaaagaattggaacaagacaaggatgcctatgtttaccactttcattcaacatagtactggaagtcctgggcataagaatcaggcatagcaatcaggcaagagaaagtaataaaaagaatccaaatcagaaaagataaagtcaaattatttgtctttgtagacaacataaacttacatttagaaaaatgaaaatactataccaagaagctcttagaactgataaacaactttagtaaagttgcagggtataaaaacatagaaaaatcaagagcttttatatacaccaataatgaaatatccataaaagacatcaagagagcattcctatttataatggtcacaaaaacaaacaaacaaacaaaacctcagaacaaatataaccaaagaggcaaaagatctctacaatgaaaactacaaagcgttcgtgaaaaaaactgaagaggacacaaacaaatggaaaatcatcacatgttcgtggatcagaggaattaatatcatgaaaatgaccatacttctcaaagcaacctacaaattaaatgcatttcctatcaaaataccaatgtcatttttcacagaattagaaaaaaaatcctaaaatttatattgaacaaagtgtctgactagccaaagcaattctgagcataaaaaaacaaagctggaaaaatcacactacccagtttcaaaatacaaggctatattaaccaaaacagcatggtactagtataaaaatagacatatacctcaaaggaacagaatagaggacccagaaataaatccacagatttacagccaatcaatcattacaaagtcttcaagaattttcattgggaaaagaggataccctcttaaacaaacggtgttggaaaactggataacaataatttttgattattgtgaaactagagccctatctctcactatgtacaaaaactaattcaagatagattaaagacaaacgtaagacctgaaactataaaacgactacaagaaaacctagggaaaactcctcagcaccttggtttaggcaaagatttcatgactaagtcctcaaaagcacaggcaacacaatcaaaaatagacaaatgggactatattcaactaaaaagcttctgcacacaaaagaaagaaatcaatcgggtgaagaaacaacctatggaataagaggaaatatttgcaagctactcatctgacaggggattaatatccagaatatacaaggaactcaatcaactcaacagtaaaaaagacaataatcccatcaagatgtgggcaaagaacatgaatacatatttatcaagaggagacatacaaatggtcaagagctatatgaacaaatgatcaacatcactaatcctcagggaaatgcaaatcaaaaccacaatgagatattatcttaccacagttagaatggctattattaaaaagacaaaaataacaattgttggcaaggatgtagtgaaacgggaactcttttacagtgttgatgggaatgtaagttagtaatcccctatggaaaacagtataatgatttatcaaaaaactaaaaatagaactaccatacaatccaacaatcccactagtgggtatttatctaaaagaaaataaatcaatatatcaaaaagatgcatgcactccaatgtttattgccacactattcacaatagcaaagatatggaatcaacctacatgtccattaatgcacaaatggattaagaggatgtggtctttatatatatgaccataaaaaagaattaaaccatgttatttgcagcaacacggatggaactgaagtacattatgttaagcaaaataagccaggcacagaatgacaaatttcacatgttctcactcatacatgggatctaaacaagtagatcacagaggtagaaagtgaaatgatggataccggagactgggaattgtgtatgggttggtgaaagaaaggttggctaatgggtacaataatacaactagatagaatatgttctaacgtttgatagcagagtagggtgattatagttaacaacaatgcattgtatttttaaaaatagctagaagacttgaaatgtacccatatataaatgataaatattagggtgatggatattctatataccctgtgtattagggttctctagagggaaagaactaataggatagatgtatatataaaggggattttattaaggagtattgactcacacaatcacaaggtgaggtcccacaataggccatctgcaggctgaggagagaggaagccagtctgaatcccaaagcctcaaaagtaaggaagccaacagtgcagccttcagtctgttgttgaaggtccaagagtcccaaagctgaagaacttggagtctaatgtttgagggcaggaagcatttagcatgggagaaaaatgtaggtggggagaccaagccagtctagtcttttcatgctcttctgcctgcttttattctggccacactggcagctcattagattgtgcccacccagattgagggtgagtctgcctttccgagtccaatgattcaaatgttaatctcctttgacaacaccctcatagacacacccaggaacaatactttgcattcttcaatccaatcaagttgacaatattaaccatcacaccctgactttatcattacatattgtacacatgtaataaatttcacatatatcccataaatatgtacaaatacaatgtatcaaaaatttaaataaaaataaaaataaaagtacagattccagtgctaagctacatgaaatgtgaaaaatcagggaaacatgacaccatcaaagcaacacaacaaatttccagtaacccacccaaaataaatgaagacctacgaaatgcctgatgacgaattcaaaataataaatctaaaggagctcagcaagctacaagagaacacagacagactactcaacaacatcaggaaaacaatacatgaacaaaaaagttccaaaaatattagaaattattaaaaaagatccaaacagaagttctggatctgaagaatacagtggcaaaactaaaaaatgcaatagaccacttcaacagcatattcaatcggagagaaataattagccaactcaaaaacacatcttttgaaattatacagtaagaagagaaaaaaatgaaaatgagaaaagcctacaggatttatggaacactatcatgacatacacattatgatattccccagaacagaagtgagagggaaaggagagaaaagcatatttaaagaaataatgactcaaaacttctcaaatctggggaagaaaatagatacctagattcaagaagcccaaataacgtcacataagtggaacataaacaggtctacactaaggcattataattaatttgtcaaaagtcaaagccaaagagataattttgaattagcaagagaaaagtgactcatcacatataaaggaacttcaatgagacttttagtggatttctcagcagaagtcttgtaggccaggagagagtgggatgatacattcaaagtattgaaattaaaaaaaaaaacctgccaacaagataactatacctggaaaaactatcctttaaaaatgaaagagagataaagtctttcccagacaaacaaaaactgaaggagataatcaccattacatatgccttataagaaacacttaagggagttcttcaaattgaaatgaaaacatgctgggcatgcactcatgcctacaatcccagcactttgggagccaaggcaggcatattgcttgagctcaggacttcaagaccagccaaggcaacatggcaaaactctgtctcaacaaaaaaataaaaaattagccaggcattgtgacatgtgcctgtagtaccagctacttgggaggctgaggtaggaggagcacctgagctcaaggaggtcaaggctgaaatgagctgtgatcacaccactgcactccagcctggatgacagagtgagaccctgtctcaaaaagtaataataaaataaaataaaaacatgctaaacagcaacataaaagcacatgaaagcataaatcttcctagtaagtgtaaatatatagacaaatacagaataatggaacattgtaatgatggtgagtaattactattaccctaatataaaagttaaaaaacaaaaatattaagaataactatcaccacaaaaatttgttaatgactgttctatataaaaggaagtacactctgactacaagaacacaatgtgagggaaggacataaaagtataaagtttttgtatgggatcaaagtaaagttgttatcaacttaaagtagatagttataactacaagatattttatgcaagccttgtagtaaccacaaataaaaaacctataatagacgcacaaaagatgaaaagaatcaaagcaaatgactataaaaaaccatcaaataaagaacacatgagaggactagaggaacaaaacaacagcaaaatggagagaaaacaatgagcaacatggcaataatatattgatatggtttggctgtgttcctacacaaatcacatcttgaaatgtagcttctataatccccacgtgttatgggagggacccagtgagaagtaattgaaccatggaggcaagtttttcccatgctgttctcatgacagtgaataagtctcagggatggttttataaagggcagttcccctgcacatgatctcttgcctaccaccatgtaagatgtgcctttgctattccttcacctttgccatgattgtgaggcctccccaggcatgtgaaactgtgagtccattaaacctatttttctgtataaattacgcagtctcaggtatgctgttatagcagtgtaagaatggactaatatagtaaattggtacccgtagagtggggtactgctattaagatacccaaaaatgtggaagcaactttggaactgggtaacaggcagagattggaacactttggatggctcagaaaaagacaggaagatgtgggaaagtttggagctccctagagatttgttgaatagttttgaccaaaaagtccaggctgaggtggtctcagatggagatgaggaacttattgagaacaggagcaaaggtgattcttgctatgctttagcaaagagactggtggcattttacccctgccctagagatctgtggaactttgaacttgagagggatgatttagggtatctggtggaagaaatttctaagcagcaaagtgttcaagatgtgacttgggtgctcttaaaagaattcagttttactgattcacaaagatatgatttgggattaaaacttatgtttaaaagggaagcagagcagaaaagttcagaaaatttgcagccttacaatgggaaagaacagaaaaacccattttctgaggagaaattcaagccagctgcagaaatttgcataagtaatgaagagccaaatgttaattgccaagacaatggggaaaatgtctccagagcatgccagcagtcttcacagcagcccctcccatcacaagctgggagacctaggagaaaaaaactggttttacgggccttgctgctttgtccagtttcaggacttggtgtcctgcgtcccagccatggctaaaaaggaccatcatacagctcaggccattgcttcagagagtgcaagccacaagccttggcagcttccacatggtgttgggcctgctggtgctcagaagtcaagaactgaggtttgggaacctctgcctagatttcagaggatgcatggaaacacctggatatccaggtagaagcctgctgtaggggcagagccctcatagagaacctctgctagggcagtgcaaaagggaaatgtggagtgggagctgtcacacagagtccccactggggcactgcctagtggagctgtgagaagagggccaccatcatccagcccccagaatggcagatccaccaacagcttgcactgtgcacctggaaaagcctcacacactcaactccagaccataaaagcatccaggaggtggtgggggctgtaccctgcaaagccacaggggtggagctgcccaagaccatgggaactcacctcttgcatcagtgtgaactggatgtgagacatggagtcaaagaagatcattttggagctttcagacttgactgccccactggatttcagacttgcatgggccctgtagcccttttgttttggtcaatttctcccatttggaacaggtgtatctatccaatgactgtacccccattgtatctaggaagtaactaacttgcttttgattttacaggctcataggcaaaagggacttgccttgcctcaggtgagactttggactgtggactttttagttaatgctggaatgaattaagactttgagggactgttggggaggcaggattggtttcgaaatgtgaagacgtgcgatttgtgagggaccaggggtggaatgacatggtttggctgtgttcctacctaaatctcatcatgaattgtagctcccataatccccaagtttcctgggagggacccagtgggaggtaattgaatcacaagggtgggtttttcccatgctattctcataatagtgaataagtctcatgaaatccaatggttttataaagggcagtttccctgcaatgctctcttgcctgctgccatgaaagatgtgcctttgctcctccccagccgtgtgaaactgtgagtctgttaaacctctttttctttataaattacccagtctcaggtatttcttcatatcagtataaaaatggacaaatacatatgttttcacttatcaataattattttaaatatatatcaattgaactttccagttcaaaagacataaaatggctgaatgaaaccaagtgttgagccataaatcataaatctcaatacatttccaaggactgaaaacttatatattccctgaccacatgaagttaaattggaaattaaataatacacttttaagaactaagtggatctaagaaatcacattatacatcatacaatattgtgaaatattattataaaaaagcaacacatcaaaatttatagactgcaactaaaacagttcctaaaggaaaatttatagctttaaatgcttacattagtaaaggagaaaggttcaaactcaaacacatttgtaacttccttaagcaactagaaaaacgagagaaaaataaacccaaaggaagtggaaggaaagaaagaataacaaccagagcagaaatcaatgaaatacaaaacagattaaaaacacaagaaattttaaaagtcaatagcgtcattgaaatgaatactctgacaagtcagcaacaaaatgaatcaaaaaaaacaaaaaggagtgaggaaacacaaattctcaatatgcccaggaatgaatgagaggatatatcgacagactctagagatgctggtagtataacaaggaaatattaagatcaacttcagtcaaaaaatgcaaaaaaataaatagacaaatacaagttactaaaagtgactgaagaaatttaaaatggaaattgtcctatagatattaaagaaattaaaatcagaacaaaaaaccttcttttgtgaagaaaacttcagacccatatagtattactggtgaattctatcaaacacataaaaagcaatagacgttggcgtggatgtggtgaaaagggacggtgcatacactgctaggtgggaatgtataacctctatgggaaacagtatggagattccttaaagaactaaaagtagatctaccacgcgatccagcaatcccactactgggtatctgcccaaaggagaagaagtcattatatgaaaaacacaaatgcacacatatgtttatttcagcacaattcacaaatgcaaagatatagaacgaaccgaagcaccaatcaaccaatgagtagatatagaaaatgtggtatgtacacaccgtggagaactactcagccataaagagaaacagaataatgtcatttgcagcaacttggatggagctggaggccattattctaagtgaagtaactcaggaatggaagaccaaattaccctgtgttctcacctgtaagtgggagctaagctatgagaatgcaaagacatacagagtgatataatggactttggagacacacaagggggaagagtgtgagggtgtgggataagaaaactacatattgggtacaatgtacactactcgggtgatgggtgcactaaaatctcagaatttaccactatataattcatccatttaaccaaaaagcacttgtaagccaaaagttattgaaataaaaaaaaattaaacagttattgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggagtacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaagagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgaggcagaaagccttggaaacttaagtgttctcaaacggaacgccatcctgctttgggggaacacggaggctgccttgcagtcacgtgatcgcgcaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggggaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttgggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtcccggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaaggaaactcgtgaccctaattccatgtctgcgcatttctggactgttgtccccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagacggctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccaggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttcttttgttggactctttagtgtcctctatataagaacatgccatctatgcatctatgaatagagatggttttacttgttcctttccgatctggatgccttttatttctttttcttgactaattgccctgactagaactttgagtacaatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccattaatatggtgtattatatacactgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggcgaacctagctggagacatgataattcatgtgctcattcttcaaaaaatattgaagggtagtgccaggtatactgtgttaagcattgagacaacaccaacgagaaatatagatcagatccctgcatgcagtctggcggaacatacagacaaggagccagacaatgacaacactatactgtgataagtgctatgagaggggaagttcaaggtgctggttatagtttggtttgtttgacccctccaaatctcatgtggaaatttgatacccagtgttggaaggtggggtctaatggaaggtgtttgagtcatggggtggatccttcatgaatggcttggtgccagcctcgcagtaatgagtgagttctcacttgattcattcccacaagagctggttgttaaaaaagagtgtagcacctcccccccaccccaccttgattcctctctcatcatgtgatctctgcacttgccggctccccttcaccttatgccatgagtggaagcagcctgagaccctcaccagaaaccaagcagatgccagcaccatgtttcctgtacagcctgcagaatcatgagccaaataaacctcttttctttataaattacccagcctcaggtattcctttatagcaacacagatggactaagaaagtgctgtaggaacacataagaggagtactttacacagacgtttggggttggggaaatgttcctggagaaatggtgtccaatatgaagcttgaagaacgagtacaagttagccaattggaaaagcggggcattggttggcaggggaggggagtggcgatggggaagtgaaaaagctctagcatgactccacagggatagagtgaggtgaccacagactttggagtcattcctggacaaatgggatgaaggaggaggtctgcgtatgggtaggaagatgagttcagtcttgagcgtgtgaaatttgaaatgcctgtgggatatccagatggagatgaaggagatttggcttaggagttcaggagtgaagtcaatactgaaaatacagatttgcgactcatcagggtagttcttgaagccatgaatgtagttgagaccattcagggagagcacatagaatatataaggggaccaaggacaacttcttttaaggggcaagcaaaagaggaacatcattggaagaagactagaggagtgtctccacagataaagttggtgcggggtgggggggcacgctaaaagataatcaagccagaaagagatgagagcaaaggtgcagaaggaagccagaggaactgaagaagaagggacaaactcagaaacacttgctgagttccaaaatgataagcattaaaacctgttcactgagttaagcaatgcaagtgttgctgggggccttggcaagagcaatttcagtggaggggctggaggcagaaactagaccagacttgtactaggagctcgtgagaaattctaagacatatcttcccaatactgggcagcatgataaatgtccacattagagagaattggtgagcaggtcatgctcagccaaggcattttacatgcctagtggaatctcatgcaggaagcttctctaagcgtagaggtaagggtaggtctgatggcaacaatctctcttacttttccttcttctgcgaatgtcttgatttcccctgcattcctgaaggtaatttcactttgtagacagggttctggttcttttgtttcgccacttgagaagtgttatgccacttcctctggcctccatggtttctaatgagaaatatattgccattctaattccttttcccgtataggtaaggtttcctttctctctctctctgcttttgggacttttttcctaggtccttagttttcagaagtttgactgtgatgcttcttggtgtaggtttctttaagattattctgtttggggttcactcagcttcttaaatgtacaggcatgtgtcttttgccgtatttagaatcttccagccattatttatttgaatactttttcagtcccacccccttcctcctttccttctgtcactatgatgacacaaaaggtagctcttttgtcatattcccacagatccccaagtctccactcatttttcccccagtcacttaggctcaggccacatgttctgaccgggggttttattgttagttccatttcaaagcctttgcaatggtatttggttctgttaagcatgatcagcagtcttggagctggcgaggtctatatcccttactcagtgcagttctcaaagtcctttgtatgtcgtacaggatcacatctgtacatacacaccttgtggggtaagcccagaagctcatacacagcttcatgggtttactttcccaagcacttcctccctccctgcaatctccccagcactttctgcttccctcagcttccccttttcaaccttgtagccatgaagctgttgctgtcgctttagtgactcttctctgccacacgcttcctgtgcctttgccttcctctggtgtgattcggcaggaagaccaaagaggggaaaaagaagtcacgggcacccctttgggacctacaatcagagaggaaggttactttccttcagagctttaatcacctgaaggccctggcggctgccactgtcactgtcactgcctctgtcaccaccactgctgccacaggattgcctgtgggctagaacatgaaagtacaaagaaaagaagaaagaaaaactggggattcccttaactatcgctgagggttagtattcccttttccctcttctcaagtcagaaccagagctctctctgttcacaccactgtctacttctaacttgcaggctacgttgagccaaggatactaaaggggggaaaatgtcaaattcactgctgtttcagtggtgcttcaaattgtagtctttccccggtctgcctccttccatttacttttcagagtcctcaaatagctggcccatgcactgtgtccacattttatagctgcattcagtagagtgtgcatgcttcatctcacccaggagcagaaacattctggagatgttacattttacttttacatttaagtggaacaaatttgttcccttgtaagtaattgatgtgtgtgtgtgtgtgtgtgcacgcgcgcgtgtgcacgcgcacgtgcttaggtgtctttaatttaaagaatttaagaaattctttaattttttttgaagtaccataacacaactagaatatatctcaatattgattgttctgcatcaatttttgatggtagagactttgtcgttttgaggagcaggttcaattcttcctttatttctggaaacttttcacatatggcatctgtggatatttttctatcccatttattaggctctttacttaaggcatgtaaattatcttaatgttggatcagcattagcgtgaccatctaaagtccttcctccatgcccttgtttcgatttgtgtgcatgtctcttctgcatcttgctcttcctaatttacttctttgatccaccatgtggttctttgagttctcggtttcttttctgagctcagtaatctccttttttaaaaaaaaaaaaaaatcatattcggttgccaatcatctggtctttgaaactttgttaagttgaaatcatattttaaattttactatggcttagagaactctagggttagttgcatctgttccttgttttatgcattcttccagtctgtgatggttatctgtcttttgtatactatgatggtttctttctttctctttcttcttcctttcttctttcttttttctttcttcttctttctttctctttctatttccttatttcttttcttctttttcttccttccctcctcccctcttctctttttccctcctttcttccttctttcttccttccttcctccctccctctctctctcctctcttccctccttttccctctccctctatccctgtagattgttagcatcattgctaaaccatttatttttatttcaattatggaaaacattgtcagacgttctatttgctctaacattctgagggtgataatttgagggcaggtgggatgttgatttcaatctaccttttcttctaagatcttgctaaatatcatgtatcatgctctagtccatccatgcaagggtgtgtcttactctgagggttttgttttgtttgcccaactcagcacggtgtcttggaaaatggaaagaattgggagccttcctaccgctggtgaaatctaggagtggcagttgagggcttctgttcacaaaggtatttacttttttctgcttattctctcagtccatttctcctcaagttagagagccttacatcccattctcaggatctgactggctcacattgtttttcctcagtattgcttccagggggtggggacagaatgagaagtgtgctaaaccagccatcctccccacaagaatttatacatatatatatatgtactataaatatatagtacatatatatgtacaataatacatatatatgtactatatataatacatatataaatacatatataaacacctatataatatacatgtatatatgaatacctatatatttatatatatgcatatatatgtatgtatatgtatatatgtatgtatatgtatatgtatatatgtatgtatatgtatatacgtatgtatgtatacatatgtgtatatatgtgcatatattatatatgtatatatttatatataaatgtgcatatatttatatatataaatctgtatatatttatatatataaatgcgtatatatacatacgtatacatttgtatgtataaatacgtatatatttgtatatataaatacgtagatataaatacatatatgtatatttatatataaatatgtatatataaatataaatgtatttatacttatataaatacatatatatgtatttataggtatataactacatatatatgtatttatagttatataactacatatatatgtatttttagttatataactacacatatatgtatttatagttacatatatatgtatttatagttatataactacatatatgtatttatagttacatctatatgtatttatagttacatatatatgtatttatagttatataactacatatatgtatttatagttatataactacatatatgtatttatagttatataactacatatatgtatttatagttatataaatacacatatgtatttatagttatataaatacacatatgtatttatagttatatacatatatatgtatttatagtgaaatacatatatatgtatttatagttatgtaaatacatataaatatatatgtatttatagttatataaatatatatacgtatttatagttatataaatgtatataaatatatacttattgttatataaatataaatatatacttatttatagttatataaatatatataaatatatacttatttatagttatataaatatataaatatatacttacttatagttatataaatatataaatttgtacttatttatagttttataaatatataaatatatacttatttatagttacatacatagataaatatatacttatttatagttatatataaatatatacatatttatagttatatataaatatatacgtatttagatttatatataaatatatacgtatttatagttatataaatatatataaatatatacgtatttatagttatataaatatatacgtatttatattatataaatatatataaatatgttcatatttgtagttatataaatatatataaatatatacgtatttatagttatataaatatatataaatttatacgtatttatagttatataaatatatacgtatttatagttatataaatatatacgtatttatagttatataaatatatacgtatttatagttatataaatacatacgtatttatagttatataaatacatatgtatttatagttatataaatatatatgaatatatatgtatttatagttatataaatatatatgaatatatatgtatttatagttatataaatatatatgaatatatatgtatttatagttatataaatatgtatatgtattgatagttatatcaatatatatgtatttatagttatataaatatatataaatatgtatgtatttatggttatataaatatatgtaaatatgtatgtatttatagttatataaatatatataaatatgtatgtatgtatagttatataaatatatataaatatatatgtaaaatatatgtatctatcgttatataaatatatatgtatctatcattatataaatatatatgtatctatcgttatataaatatatatgtatctatcgttatataaatatatatgtatctatcgttatataaatatatatgtatctatagttatataaacatatatgtatctatagttatataaatatatatgtatttatagttatataaatatatatgtgtttatagttatataaacacatgtatatttttgtatttatataaatataaatacatgtatatttatgtatttatataactataaatacatgtgtatttatgtatttatatttatataaatatacatgtatatttatgtatttatatttatataaatatgcatgtatttatatttatataaatacatgtaaatatacatgtatttatataaatagatagacatatatttatataaatacatgtaaatattcatgtatgtatgtttatataaatacatgtaaatatacatgcatgtatatttatataaatacatgtaaatatacatgcatgtatatttatataaatacatgtaaatatacatgcatgtatatttatataaatatatatgtaatatacatgcatgtatatttatataaatatatatgtaatatacatgtatgtatatttatataaatatatatgtaatatacgtgtatgtatatttatataaatatatttgtaacatacatgtatgtatattggtgtaaatatatatgtaacatacgtgtaagtacatttatataaatatatatgtaatatacatgtaagtatatttatataaatatatatgtaatatacatgtatttatatttgtatctatatatgtaatatacatgtatttatataaatacttatataatatacatgtagatatacatacatgtgtaatgcatgtatgtatattcatataaatatatatatatatattcctgggaagccactttcctccctctctccctccttctcctgcttctcctccttagtcttctcttcttctcctccttagtcttctcttcttctcattctgctttttaccattatttatgtattattttttaatttatttagtaggatcggggaagggagattcttttatctttcttcactctgccatcttttacaaataaattgtaatgttactgactccaagttaagataaaagtttgcttgcttgaatgtgattattgctttgcttgagtttgtagattattcactaaaaatagtctcaggaaaacaggaccttcaacagagataaaagaaaacacgccaaccagcagctctgggaaggggctgaccagcctggtaagaataggctgacggtgcctgtggaaggtcacaaaacactgaccaagaaagcagtgattaactgcccacctgagactgaacacgttttagaagaatgttttgatcattatttcctctgctttcccttaaaaaaccctaatccagaggcacaactcagagaggtgatcactgaagtctagttcactgactcctcccggttgctggcttctcaaataaagctaactttcctttcaccaaagctcctctctttgagtttttggccttcaggtgatgaatggcctggaccggagttcagttacaaaatctctggttttgaagggttatttttttattcctgggatatattccggctgacttggagttagttttagataaatgtaagctttctaatggatctgaatccacactaacggatatgaaattatcaaggtctttttatttttaatcgcaaacacttcattttatcaaatcttaatcgtctccaatttcaccgcaaacaatgcaaggaccttgtcttacaagtcagtgctgtccagtatttagttataatttggtcagtcatattgtttttatgcagtctttttttttttttttttggactcatggccatggttactagtttctttgttcaccattcctctgttgcatcttgctttgttcttttcgttcaatttccttttaatggaagaacatctttaagtcgttctttcagtgagggtttgtgagtggtcagccctctcaacctttgttgaagaatatctttactggctgggtgcagtggctcacacctgtaatcccagcattttgggaggccgaggtgggaggatcatttgagctcaggagttcaagaccaggctgggcaacataatgagactttgtctctacaaaataataaataaataaataaatagccgggagtggtggtgctcacctgtagtcccagctactggggaaaaaaaaaaaattagccaggcatggaggtgcacacctgtagtcctagctactagggaggctgaggcaggaggatcccttgagcccatgagatcgaggctgcagtgagccatgatcgcaccactgtaccccaacctgggcgacagagtgagaccttgtctcaacaaataaataaataaatattttaaaatatatcaaaaagactatctttatttcactcattcttgaattgtagtttagttgggtatgacatttccccccattccccgaatgcattagtgatatgattccatttttattgcagttggtgagaagtctgctgtcagtttattatccctttgatagcactgtgtcttttctttctggttgattttaagatctttccccttttctttgttgacctgcgccggttcccctgtgattcagttttattgattcttgctgtggctcatgcttttagaatacgaggaactatgtctgttttcaaatctgaaaatttccagccagtatccttttgattattggtttacccctgctctctttattctctgattctgtcattcctattagagtttttttggacctttgcatcatttttctgtatctcttaaccgtttatacatttgctatctctccttgctgccttctgaataatttccttacttctatcttccagttcactaaagcagatgaatctgcttttaaacccatcctctgatcttttgctgtcactggaaataatgtctttcattttcggaagttctatttggttccttaaagaaagaaaccggcctcttctttttccgtagaatcttgatctttctcatatgtttggattccttattgtttctaagtatcttatacaaacttattttatactctcggttggctctattatctaaagtttttggtagtgtaatcctgctcatcattgtgtttgctgatactcaatcacaggcggtttttttttttcctcaggtgttttataattttgtttgtgagtttagggatttgttcaaacggcttcatctgtgtgacttcaatgaggtttgactgggggtgtatctctggctgttatctttttgatgttaatgtgtaagcttggggttttcaagacctaaataagaggtattaattccaaccctagacctacatgacaatagccttagagttacaaatgaccaggggaagcattttattttctcccaccagaacccatgaagaaacaaactctcttgtcatctcaccatggtggtgggaagacttttttttcctagtccatcctttcactgactgtgtagcccttgtgaggcaccaaggcttttctcctctccctggtggttattgaatccattcccctaccaccctaacataaattcaaatgcccattgatctgctctttaggttcctctttgttttttgacacctgagggtcaacttccaccataagttcatcacatgtgcattaaaaggaatatttattaaattttatcctgccttttaaaaggtgctttgtaacaggagggttttcaggttatctagtgtgcactgtttccagaaatggaaattgctttcccctttaaaactcccagagcactaagaagctcccacaaattctctggaagaggaatgtgatgggggcgggggaagacttttcatgaatatgtagcctcaaagaaagattggtgctttggggtgccagacactcaatgacagcttaagatgagtgaggaagggcctaggggttgaaagagccctaattgctcaaagccacatgtcacaagaaattttgggaagaagagccactttatgaactggttaccttcatggatttttcttccctaggctcagaagtggaaaaatatgaagatccattgctgatgggaatcctgccctaagcaaacggtggtgagacatggctgcttttagtgcatttattatatgtgaccatttaaaagcaggtactgaaggctgcagaaaagtcacgaggtggtactcaaaatatggttatataggtaactgggtgtggctcttccctgaggcacaaagaactgattttttttgtgtgctctttgaaaggaaatgtataaagttggtattatgctttactcagaaagtttttaagagggttgggagtgatgcaatcactttaaaatgatatacaaggttgaacactctgctaagcttcaggtaagagtatccaattgcctcttggacttccctgcctggatgttctgttccacatgcaccccaaactcaaatatatccaagactgaaaacatcttctctccaagctctctcctcttctaatattccctgtgtgaataaggtgtgcccagttgaccaaaccagtaacctgggagtcatcttgacaacttcctctccctcaacccctctctcgcaattaattggacaccaagttcagtggactctaccttcaaaatgcctctcaaatcaatccacgtctctccttggcattgctgtcgggcagcagggcccaggttcccactcctcttggaaatgacagaggtctcgcctcttctgcaccttcccccgagcttgaggatctatcctgtccagaagaaatcctttccctttcatatttctatagaatgctgtctaacactttgaattcccttcaggctctgggtttcagaaatcaacacagaaagaatgccgggctattcatttccctccaggatgaagttagaatcttgagggcagcgaggaaggcaggcatatgcattgttgcaaaccttctcaagtgattcagatgtgcagctccggtcaagagccactgcacaacgtggtgagctatttgaatacagggaccatgcctttcaactttgtattcatcaaaacacaacgcagccaatacctgatatagaatcagtgctcagtaaatgttccagtgaatgagtgaatacaagaactaaagaatgatatggtgcaaagaaatggatgaaagggatcttacgagctacttagtgcaatcccttcatttttttttttttcagttgccgtagcgttgggattgcttgaggctcccggatgttcacaggatgtcatttttggcaaccacagaccactagttacccagcttttttaggtgttgtgtagcaaggagggatttcgggttatgtaatctgcaatatttccagaaatggaaattatttctttttccttttatgactcacacaacgtcaggaaatttccacaaaattcccagaagaacatgatggaggaaaccactttccctatatatattttagtggaatatattttattttaatggaactgccagtgaagcagtagatgtggccagcagacactgctttcctggtgtctcctgagaactcttttctctcattggttattttcacctgccttcttctgcaagttcctttttgtttgggctcattttccattttctctgtatccaggtttgttgaaaatgcaggagccagtgcttcccaaccttccctactccaaacgcctatgcacacgcacccacttgcatgcgtgcacgtacacgtgcatacatatacacccacacgtacatgcgtgtgtgcacacacactcctggactcttgagaagctttcaaaaggaacttatagatagggtgaggacttttactattaattattaattattattattattacttatatctgaaatataacattttggacacacggaagtgctctaacccccaaattcctgtttgtctctggaaaggagcaggcagtctaggatgggcagggacacacaagacaacttatcttttgccatatgcattagacctaaagtatttacaaagcaaaagaggcagctgtggcgagacagaaaaagccctggattcagaattaaaacagctgggttagagtactggctctgtcacttgctctctaactctcagtttcctcatctgtaaaatcggggcaatggtactacttcatattaatacaacctcagctgcaaaagactggtttaggtacccttgttctgagctcccacagactccttgtgcttacctggtgttaacattggctgttaatacatgtgtctcccgtggtacaaggagatcttgagggcagaaattctatttgtctggcctccagcgtgcctgccctcagtgcacagcagaatggtcaatgaatgttggttgagtgaatgaagaacaatcggacatttgcatgtttttgtgtgtataattcctgttgtactatcatcggtagaccgccaggatagtacaaatctatttttattgtatgtaaatttgacatatagacattccaaattaacaggagttgattcgctccccatgttacctaacaactagtttcggaatgttgttggatccctttaggagaatatttcagtacatttgctcccctggttagggttaggggttagggttagggttagggttgtgttcccagcacaagcgtctcctcaataataagccttcacgtgtgtgcaccggcactttaaagagttgttgttgttgttgttttaaaggtgttttctcgtacactgacttatatgctcctcacgagaaccccatgagacaggcaggaaaggtgttcctgctaccacttgatggatgaagaaaccaatgttcagagacattaactgagtcactacacaccacatcaagagcaagtttgtttcagagctgggcctcaaacagaatcgggtttctcatttcacagtctggtgttttttacacaatccatttgttcaacccggctgcaatttgtgatgttgcttcagtgatattttttgcatctcatcctattcctgcttcacaactgcacctcctaccacttgcctcagcatactctcaaccggggcttctcaggtgctcaaccagggcctctccctctaccctgaacatgtcctcttgcaatttcctgcctctggatctttgcatctgttttcacctcttggtgggcacccgttccccacccccacgtcactgcaggttgaaagaaaccctaggcatcctctcggtttcaactcaaagaccacctaacttcatgaaacctctgcagatgggccctgctggatgagatctctctgcccttgaatgcacagagcagtccatgtcttgttctatatccatttccatacctgcttcattcccttctctacagtgtcccttgctccgtgttctcacagccccctgtgctcagttttcacagcacatattgccctatgttgtgagcctgctttcgtcctgtgactgtgagctccttgaggactggaaccttgtctgacttatctcggtatctccagcacgcagcacagtgccggaacacagtagttgctccaaaaaatgttggatgaatgagtggatggatgaatgaacactaccccacacaacgccttggatatagtggctgcaaaataataatggatcaaattgagtctataaccagatctcatttcttttcatcctatctcagtgaaagatgaaggtgctttcttctgactcaggctgtcacttccactcctgctctgggttcgatcccatcctgcctccccaggtgcctcactccatcaattacctcttctctcaagaatgtctaatctctccgtcttctctgcctggctcctttccttgcagtaactaaaatgctcaggtctctcctcctattccaaaaataagtaccctcaattgaatgggtgtcttcttcctcacagtatcaagatatgtacctcatcggggagtaacccagctgagtgagccctttactggggagccttcagtgtgagtctccttagatctttttctcttaggttggtcagatggctcacagaagactcttccagctgccagaagtttaggggcaggggcagggaagaagactgggagttcacagctttcaggacacatgcttccactcaacacccctgttttcagtacaggaccccagccctcaactaagtctgcgaactccccatccagagaccctctgctttaccctctccagggaataacactccaggcttctgtcagagcagggaagggccagcccctcactggcattgacagcaggaggggatttggcaatgaatctacttcttaaaagagttttcaaacagccttcattattttgatacccaccccccttcacttccagaggtaactccacttccagagttaccttggtccagcctttgaagattcctgggggtgaggagtaaatcaagttagctttttgcttttcccactaaggtctcagaattcctagtttgtggccttcttggatctgctaagtcagttgccactcatccatctgttcttcagcatccaaaatttagttgttgcctcctttcctgttcttcaaccctttttatttcatcttcactcctatccttctaatcctttcaaaaatcacatttgtagcagttccagtggggttttgggagatggtgaagttagatgtggaagtatgtgctccaccttaactatgcatcatcacgagcatgggtgtctgcctgcctgtctcattgattctacacaccttcattaccacaccactctccctaaaactctccagactcagcttttctcatctggctctctgacctgttccctgaccattctgttctttcagctctcagccttcggactgccaaaaccccaagccaacttcctatccaggaaccctccggcctagaagttcagatgtcttgccaatatatctgtgcttcacaacttgcctactctctctgacccctaacattttcacatacttttccaattctgcctgtcataaatttgctgcttccccctaagtagaatgttgattcctgtcaaacacacagcctagccctgattcctcctcttctctcaagcagtgatattgtcaacaatgataaacaactactatgtactgagtgtttttttatgtgctgctcacactttatacacatgtatagattcattcttcatcatagatttttcagctagctggcatttattagccccactttgcatatgtaggaacacaggctcaaggaaagaaagcaacttcccacaatttcccaggctagtaaaagtcagagatggaattcaagcccagatcattccaagtttgtgctcttcctgtgacacgacactgcctcagtcaaggcatcagagaggaagttagaaagcagatggtgagagggagtacctgaattggagggagtacctgaattggagggagtggccaccatcagtgggtagaccatggagaaagatggggctaacagagaaaaaccttcactgagttcacagttttacacagcattagcccttgtgatctttagtcgtgcaggggataaattaccgtgcctgcctgcccacacagaaagtaagctagaacaccactactaatctatatgatatacaccaacatggcttaagacgatttattgcaactgtaaaaaaatgcgcgcccccccccttttttttccagaaaggaagcgtggattgcattaatcaagctaaagacttttatacttctttacagtctgacacaaaaacagacagtcataaagataagcccgaatcatcaagaaagtgcacagtagtattttgcaaacccaatttagggaatcagggaagagtaaaatccacatggataaggtttccccttacttcccattcgtgatggtacagtgagttcatgttatggaacgcccactgctccaaacacatggcaatgatggacaaaatataaaaaggtaaactcaaaaaggcatggccaagacaaaacaaacaaaacaaaacaaaaacaaaagataattgtctccatgttgaagtactaggcttgttgctctggaagcaaaccatggtaaccagaagctaagctcctgcaatgtatagcggttccaaagtaccctgagcaagatggaagacaaaagccatactcacagattaaagcccaggactagaatggagctacccacaaacccaccaacccctgactgtaagtctgacaaaaaagaactaccaccaaactctgccagggtctttggttctgatgagctgcaggcttaaggaggtgaggatgcagacatgttctggtctcgtaactaagagttgagctaatccacagctgagctaagtgagtggatttccaatatgcccaagagcaccctggggccagtgatatggatatgttctatcaaagggttttgagcctaacaactgactggtatttttcaagagaaaaaacagtactgaataggttaatttccttccattcttggaagaggcaaaattagaaatgatgaattttttttttttttttttttttgagacatggtcttgctctgttacccaggctggagtgcagtggcgtgatcatagctcacagtagccttgaactgctgggctcaagagatcctcccacctcagcttcccgagtagctgggactgcaggcactcatgactccacccaactaacttttcttttaattctatttttttgtagaaacggggtcttgctttgctgctcaggctggtttcaaactcctgacctcaagcgatcctcctgccttggcctccaaaagtgctgggattacaggcgtgagccacggcacctggctagattttgcttttaagtttgaaatgctttatttagagtttattagccactaactccttttttttttttttttaaacttttaagttcaggggtacaagtgcaggtttgttacataggtaaacttgtgtcataggggatttgttgcatagattatttcatcacccaggtgttaagcttagtacccattagttgtttttcttgatcctctccctcctcacaccctctatcctccaaaaggccccagtgtgtgttgttcccctctatgtgtccatatgttctcatcatttaactctcacttataagtgagaacatgcagtatttggttttctctttctgtgttggtctgctaaggataagggcctccagctccatccatgtccctgcgaaggacattatctcattctttttcacggctgcatagtattccatggtgtatatgtaccacattatctttctccagtctgtcactgttggggatttaggctgattccatgtctttgctattgtgagtagtgctgcaatgagcatacacatgcatgtgtctttgtaacagaatgatttttagtcctttgggtgtagacccagtaatgggattgctgggttgaatggtatttctgtctttaggtctttgaggaatcaccacactgtcttccacagtggctgaacttgtttacaatcccacagacagtgtataagcattcctttttctccacagcctcgccagcatctgttattttttgactttttaataatggccattttggctaatattagttgggatctcattgtggttttgatttgcatttctctaatgatcagtgatgttgacctttttttttcatatgattgttggctgcatgtatgtctcctcttgaaaagtgtctgttcatgtccttttcccacttttttatgggattgtttgttttcctgtaaatttgtttaagttctttatagatgctggatattagacctttgtcagatgcatagtttgcaaatattttctcccattctgtaggttgtctgtttactctgttgatagtttctttcactgtgcacagctctttaattttattagaccccatttgtcaattttttgcttttgttgcaattgcttttggcgtcttcatcatgaaatctttgcccatgcctatgccctgaatggcattgcctaagttgtctttcagagttttcatagttgggggttttacatgtcagtctttaatccatcttgagtcaatctttgtatatagtgtaagcaagggagccggttttcatcttctgcacatggctagccagttatcccagcaccatttattgaaccgggaatcctttccccattgcttgtttttgtcaggtttgtcgaagatcagttagttgtaggtgtgtggtctcatttctcggttctctgttctgttccatttgtctatgtgtctgttcttgtaccagcaccatgctgtttgggttactgtagccttgtagcatagtttgaagtcaggtagcatgatgcctccagctttgtcctttttgcttaggattgccttcggtattcgggctttttttgttttttggttccatatgaattttaaaatagttttttttttctcgttctgtgaagactgtcaatggtagtttaatgggaatagcattgaatctataaattgctttgggcagtatgcccattttaatactgattcttcctatccatgagcttggaatgtttttccatttttttgtgtgtcatctccgatttctttgagcagtggtttgtagttctccttgtagagatctttcacctccctagttagctgtattcctaggtattttattctttttgtagcaattgtgaatgggagttcattgctgatttggctgtcggctttactgttgctggtgtataggaatgctagtgatttttgcacattgattctgtaccctgagactttgctgaagttgtttatcagcttaagaggcctttgggctgagacaacggggttttctagatataggatcatgtcatctgcaagcagggataggttgacttcctcccttccaatttggatgccctttatttctttcacttgcctgattgccctggccagaacttccaatactatgttgaataggagtggtgagagagggcatccttgtcttgtgccggttttcaaggggaatgcttccagctgttgtccattcagtatgatgttggctgtgcgtttgtcacagatggctcttattattttgaggcatggtccttcaatacctagtttattgagagtttttaacatgaagcgatgttgaattttatcaaaagccttttctgcatctattgagataatcatgtggtttttgtctttagttctgtttatgtgatgagtcacatttattgatctgcatatgttgaaccaaccttgcatcccagggaggaagccaacttgatcgtggtggataagctttttgatgtgctgctggattcagtttgccagcattttgttgaggatttttgcattgatgttcatgaaggatactggcctgaagttttcttttgttgttgtatctctgccaggttttggtttcaggatgatgctggcctcatagaatgagttagggaggagtccctccttctcaattttttgaaatagtatcagtaggaatgctaccagttcctctttgtacatctggtagaattcagctgtgaatccatctggtcctgggatttttttggttggtaggctatttattactgcctcaatttccaaactcattactggtctgttcagggattcagtttcttcctggttcagccttggggaggtgtgtgtgtccaggaatttgtccatttcttctagacttcctagtttatgtgcccagaggtgttcacaatattctctggtggttgtttgtatttctgtggggtcagtgataaatattccccttatcatttctgattgtgtttattcaaatcttctctctttccttctttattcgtctagctagcggtctattttattactttttttcaaagaaaaaaaaaacagcttctggattctttcattttttgaagggtttttcatgtctctgtctccttcagttcagctctgatttttgttatttcttgtcttctgctagttttgggatttgtttgctctcgcttctctagttcttttagtagtgatgttaggttattaacttgagatctttctaactttttgatgtgggcatttagtgctataaatttccttcttaacactgcctttgctgtatcccagagattctggtactttgtatctttgttctcattagtttcatagaacttcttgatttctgcctaaatttcattgtttacccaaaagtcattcaggagcaggttattcaatttccatgtaattgcatggttttgagtgaatttcttaatcttgatttcaaatttgattcttctgtggcccaagagactgtttgtcatgatttcagttcttttgcatttgtcgaggagtgttttacttctgattatgtggtcgattttagagtaagtgccttgcggtgatcagaagaatgtatattctgttgttttggggtggagagttctgtagatatccaccaggtccatttgatccagtgctgagttcaggtcctgaatatctttgttaactgtctgtctcaatgatctgtctaatattgtcagtggggtgttaaaaagtctcccactatcattgcctggcagtctaagtctctgtgaaggcctctaagaacttgctttataaatctgggtgctcctgtgttgggtccatatgtatttaggatagttagattttcttgttgaattgaaccatttaccattatgtaatgcccttctttgtgttttttgatctttgttgatttaaagtctgttttgtcagaaactaggattgcaactgctgcttttttatgttttccgtttgcttggtagattttcatccatctttttattttgagcctatgtgtgtcattgcatgtgagatggttctcttgaagacagcataccattggatcttagttccttatccagcttgctactctgtgtcttttaactggggcatttagcccatttacaatttaaggttagtattggtatgtttggatttgatcctttcatcatgatgctagctggttattttgcagacttgcttacatgtttgctctgtagtgtcactggtctgagtacttcagtgtgtttttggagtggctggtaaccatctttcctttctacatttagtgcttccttcaggagctcttgtagggcaggtctggtggtaacaaattcccttaacatttgcttgtctgaaaataatcttatttcttcttcgcttatgaagcttactttggccagatatgaaattctgggttggagtttctttaagaatgttgagtattgacccccaatctcttctggcttgtaggttttccactgagacatccactgttagtctgaagggcttccctttgtaggtgacctggcctttctctctagccgcctttaacattttttctttcgtttcaaccttggagaatctgatgattatgtgtgttggggatgttcctttcgtggagtatcttcctggagttctctggatttcctgaatttgaatgttggcctctctagctaggttagggaatttctcatagatgatatcctgaaatgcgttttccaaattggttccgttttccccatctctttcagggacaccaatcagtcttagattcgctctctttacgtgatcccatatttctcggaggttttgttcattgcttttcattcttttttctctattcttgtctgccagtcttatttcagaaagccagtcttcaagctctgaaattctttcctccgctttgtctattctgctattagtacttgtgattgcattatgaaattcttgtagtgtgttttttcagttccgtcaggttggttacattcttctctacatgggctattttgtctgtcagctcctgcaatgttttatcatgatttttagcttgcttgcattgggttacaatgtactcttttaactcagtgaagttcatttctatccatattctgaattctacttatgtcatttcagccatctcagcctcagcccaattccgaacccttgctagagaggtgatgcagtcatttggaggaaagagggcactctggcttcttgagttttcagcattcttgcactgattctttctcatctttgtgggcttatctaccttcagtctttgaggttgctgacctttggattttttttttcttttaacagtctggccatgtttctgtagggctgctgtactttgctgggcttcttctccagttcctagtctccttggattttccagtacctggagctatcaccagtgaaggctgtgaaacagcaaagatgtcagcctgcctcttcctctgggagctccggcccagcgaggtacagacctgttgccagcccaaatgcgcctgcaggacaaggctggagaccctggttgggaggtctcacccagtcaggaggaacgggatcagggaactgcttaaagaagcagtctgtccatgctttcacagatcagctgtgctgtgctggggcactgcttccacccctggttggtgtgggctctccaaagcctggaggccggaacagctaagtcgcccaaacagcaaagatggtggcccctccctccctccgggagctctgtcccagggagaattcaaatctctgtcagccagagaacaccagtaggggttgctggaggccttggttgaaaagtcccacccagtgaggaggaacagattgggcacctgcttaaagaagcagtctggccatgcttctgaagagcagctgtgctgtgctgttctggggtaccacttctgggagctctgtcccagagagcagcctgcccttccccctgggacctctgtcccaggtaggtgcaacactgctgctggtggctggctggaattccaaaccagtgggtcttatcctgtgaggtgcagtggaagtggggcccgcagatcgtgccgcttggccccctggattcagcctctttcctaggggtatgtacaggggtctaatctcccgctttgcaggagttgcagttacttttgctgggaaacccagggccggagtatgtaaagctgctgggtctctgcacgtgctcaagcggctactctgctgagactccatgtatctctgtgtgtcagactgaaggccctggtggagtgggttcaccaggggatctcctgacccaagggttgcaaggatccatgggaggagcgtggtttcccaggatcgcacattcacttacgacttccctgggtggaggaggttcctctgtctccatgttgctcctgggtgggctgtcatcctgccttgcttttcttcattctctgtggatcgagttgtttccttgattagacccaatgtgggtacctggatgtttcagttgaaggcgctgtatttactcgcccctttccttcccctccatgagaaccactcaccctagctgcttctagtcagccatcttggccactccctccccgccccccaccttttttttttaaatgcttgaaaactatttgcaaaagaaacctagagattctcatggttcttttaagatcttgttggatggactgtgaaagtgggattattgtctatgaatggtcagctagactgtgtgtgtgtggaaagggtgagggaattaacatttattgagcaaaagggcatgctagttaaaatcattgtctctggggacagatttttctgggttttaatccaaactctgacacgtattagccgtgtgacctctatttttcatttgtaaaatggagatgggattgttgcggggattaaaagcacttacaacagtccaggatatagaaagcactgtgtaagagctggctgtcatatattagtcatcagtcatcatacttaataatcacaaaattgttagaaaatcctgtgaggtaggtattttccttaccatacccatatgagaaaacttaagcaaggagaagtcaaacaaagttaccaaagtcacacaattacggagtgacagagcctttagacgctgcctagtccaaggctttcatttcacagaagagaaaactgaagttcaaaataggagagggacatgcctgaagtcatttagtgagccagtgacagaactgggcctagaactcagcagcaggactcttcctgtcagtagttctcaaactttgtcatgtgttacaatcctgcagaggacttgctaaaacaaactgctggtacccatgcctagagtttcttacttagtaggcgtggggtgggccttgaaaatttgcatttctaaggagttctcaaatgatgccactgctggtggtctggggaccctactttgggaaccaccacaacacaccataattcatacatcttttgttcttttcatcatggactacacagtgtgtgacctacaaacactttcaaagaaatgggaaccggtgatgaaaaccaaagaaaattacatatctagcagcaagaaggtacggtgactgaccaacagtcctggtttgtgtgggactctcctacttttaaaatggaaagtcctgtagttctgggcacaagaggatggttggtcactctagatgaaagcaaacaaaagtcagtgtcagctaaatgccaaacgaaaaaggacatacatacagagaatgtggtaacttctggtgaatttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggata

SEQ ID NO: 573 - DNA, 81781 bp, Homo sapiens
ggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatggcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaagaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagtagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttaacttcatccttgagccgtctatgttaacacacgtaattcacaggacctcagctgtctcctccctccagcctgttaggaagtcaggtacagatttatgctctaagcaggaattattttcctgctcttttcttggggctacatatggcctttttttttttttttttttttttttgagacggagtctcgctctgttgcccaggctggagtgcagtggcgcgatctcagctcactgcaagctctgcctcccgggttcacgccattctcctgcctcagcctcgcgagtagctgggactacaggcgcccgccacaacacccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcgtggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtccgaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccacagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttaatatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacacctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctaaaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcaggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttcttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtgaggagggtagagtttaaaacattgtgatacaaatgcaaaaactttgaattaaaaatgaactcgcagtgggggagtttttgcatttaacgttgatgctgatctatgtacttctgtcgattcttctttgtggtgtgtgtttaacagtgaggagtgaaaggtgggtgggaagagagcagggtgcgcagccaggggcaccacctcccacttggctcccaggtgggtgcagtgaggctgctgaataccctttgggctcgtggtgtattcttgtgactcaaggaatcaggataggggctgctgggccgacctctgtcctccatggacgcacgtaacagtgggcagttatttccagagtggtccaccaggggcagaccggggagggaaagcagtctacgtgatattcactggatgttcaccagaattacagcaaagtagagcagtagaacagtctccttaagagagtattctttctaaacgtattttcccgcctggagatttaagatggaacctgagtgaggttcacaggcaggcaatgtctttccccttggttcccaccccagtccgctctgcaggggtgcatttcagtgagttctgcaggcttggaggagtcagctccagggcacaagccccagtcaaaaggaaatcatgacaatggcccatgccccatattagaaatcacagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttgaatatccctggctccagggatcccttttctattgacacagctgccggcatttacctatgtgagcttttagcttgcttagctatgcttgcagcttgatttttcaggctgctttttgttataaaagacatgatttaggagctgctttttattgcaaggaaaccttacagaggactctgttaccctcactatctgcctaaataatttctttctagctctgaatcactttgtctaaacataagaaattcaatgaggtgcagttgaatgaaaaaaaaggaaaagattccttggagcagggccacaaggagaactcagaagcgccaagggctggtcctggtaacccaggctattgcttgaggccctccagaagatgcagggggtccctcactgcaggcattgtcatcagttccagggtgtggtcctggagggaattcaaagggacttcccagcctcaatgacaaagccctgagaaggcagacagcatccctcacccttgtaagacagccagagattacctccaacccctttttagtcttaatggactcttcagctggacctagaaaccaaattgataccaggccagattaacaaaagaaaagcttaccaattttactagttttacatgtttatggggatcctcacaagacagtgaagtctaaagaagtggccaaaacaacatgcttttataatctttagacaaagaaccatacatttaaggagaaatgacaggacaaataaaatctggctagaaggagtaaattttctagagaaggcgctaggagatatgaggagggtgtaaaaccagtggaagataagggatactgtgttaaatatgtttactcaggcccattgcagctccaatgcccagtctctgatgataaggggcattttctcatcctgctacaggaagggtctccttcccagaggaatctttatggcttgctgcaggcatgaagagacaggtcagttagtcctatccgaaactacaatgtatccaatattttcaactcaaaataatcaatatcccaatctggcatattttgggatggcccatgcttcactccttccccctctcactttccaaagaggaaacacaacatcagagtcctgccctgtgcaggtcactcaaggaggcagcgtgaaagccaggaaggaaacactggccctaagaaaagcaggaatcagtcaggaagccttccactgtagtgttttccagagccaagtcatgcttggggtgattaaagacaccagtggggaaagcccttgcaaatggagagaagttggtgctcttgatcctgaaaaacggtttcctaatagtcccagccctccagtgggggcctctgccgaatggagaaatttcctgggctctccaggttctctgagagtcagggaggctctagatgcggctcaaattcctgtttaaagatcaacaagcccaagataaaacatgaattcccaggaccttggtgagatgtcccctggctccctgcacaacctcagctccaaggctttcctctgagcggcacatcctctgagagccctgggtcattcacagggtcggtggccactgccggagctcctgctatgcaggctgccaccccaggtgcaagcctcacagaagcctcagaccctgtccctatcagaccttatagttggggctggggcagacaggcaataaacaataagctaaaaataagtgtgtcctatgatgtgtcttaggaaagggatgactccagtgggaattctaagcaaggagggcacaggggcctggaggatatcacgtgtatatatggggttttttaagccctctcgtgtcgaagtagtttctcacagttgcctgcagcacagaagcacattggagcttctagaatgtggtggattcaatgaagggactacaggtggtcctagtatattctctgttttgttttgttttgctttgttttttcattttttcctcagtagtaaacagccactctctccaaggtgatatatagagacagacagagagagcgggagggaggtagatgaagggagagaaggagggagggagggagagaaatagtctcattagcacaaacccaggtatggttgaagggggtttattatgagtaacaaaagatgctgctttcagcccaacaatcaggaaattccaagggttttaggagctctgtgccaggaacccaggataaagaccatatatctctttatataaaatcacacactggaaactttaaaagagaacagaaaattatggggagggaagcctcacacttccagcaggggctccagataggccgcctttagggattgcagctgagacctgcaggctaagaagcaaggttgagtgcagggatgaggggagaggaggagggtcactgggtacaaggagcagagcagaatctgcactctggcccgaaagcagagtggcaggccagggcaggccaggaagctgggcacgcaagggcactgcatcaccctcctgctgctgaagcacagctgtgtcccagcttcctggaggcagcatctcccatggatgtacaggagagatttcctaggagacctgaccaggtgtttttcctgaggacgagtctgtattcctgtttccctgcatttgtttgctccttggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatccagaaatcttgcaaaataagaaaaataacttctaagtgaggatcgattatcagggttttagtacttacttccaactgatctgtacaggatgtctgtgtaagacaaaacagaagtgtctgtaagtgtttgtttagagactgcgaactgttaatgcttttgcccatagtttactgacattagtgcctccctggccagcagtggcagtaaggactggctatattaaggtggatcatagacaagccctgggtctttgctcctgccatgacatgttttgagctttcctaagaacccatatcaacagcccattttcagaaaatccagagccatcgattagagcgtggaaagggagaattaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatgattttcatggaagttattaggatgtggtaagtcacactgtcaaatagtgtcaagcagcattgtcaaaggggtagctaaatgttttctaaaacattaagtccctgccatgtcccaaaaaagtgaatgtgttggccgggtgcagtggctcatgcctgtaatcccagcagtttgggagcccaaggcaggaggatctcttgagcccagagtttgagaccagcctggacaacatagtaagactttagctctgcagaaatcaaaacattagccgggtgtggtggtatgcacctgtagtcccagctacttgggaggctggggcaggaagattgcttgagcctgggaggtcgaggctgaaatgagctgtgatggcaccactgcactcccagctgggtgacagagcaagatcctatctcaaaaaaaaaagtggatgtgcacaggtcaaagttgactgtgagattccaccacacagaacggcggggaggcccatcagggagggccctgtcctgccctgcctctatcttttattcatgagcagagcatctacccagccagggcctgacagcccatggcctgcctaataaaagacagactgaggagacccagaaatcccccatcaggccaaagcagggctgtgggttttgagctatccctttctctatgaagacagcctaaaaggaactgcggtaggcaaagaaaggattccagagccccaatttctgcctgttctaaggaggttacacacatgcgcagacatgcacacatatacatccacatgcacacatgcattcacacatgcacagaaggcatgcacacgtgtacatatgcacacatgcatatatgtcagtgcatacatgtatatgcacacatgtacatacacatgtgcatgggcacaaatgcatgcatttacatgaacacatgcatccacacacataagcacatgcacaaatgtacacatgcattcacacatgtgcacacatgtgcatgcatgtacatacacctgtacccacatgcacacatatacatacacatatgcagagacgggcacacatacatacacatgcacacaaatacacagaacatgcatgcaccacacagtacacatatacacataccaaacacataccacatacaccttcacacaccacacacatacatacactgcgcatacacatactatgccatacacacacaccacgcaagcacacacacacaaaacgcacacaccaccgcacatactgaaccttactccaaataaccacttaaaaatccatgtgaggcagtggtcctgcagtggacacaccctcgtgtctgtatccatcttcattaccaccctctctggtgtcaagcactaagggactctcctcacaatcttccatcctagcctcccctgggtcccctctgctcttgccaagccaagttaggtttggaggaaacaattaagttggctgggccaaggctccctgggtcagctgggagatgggaaggacacagactgcccagtagcccagtggcctgcggggggctgctccaaatacagtggggtggtgaagagccctgaagtcagagaagaacacaacacacaagagaccactgggctccagcactgaccttaggcatgtcctataaattgaacccctgagcaccacaatttcagctgagggtgcctatgctgacacatgtaagtgccagcacagtggccttattctaaaaatgtcagcagatgccatggtctgtgctgttcatgccagtggccatctgctgggaggaatgctgcaggcagcagacggcgcaggccctaggacagctctggaaataagcactggcctttggcttcaaccccagggagggaaaaactcttgtgataatgtatcactgcactgcagtgagatggctttaccactagcctgagctgcagcagagaagcggtttaagaccccggggcttgtccttcggagatgaggaggggactttagaactgatagataaatatattctcattttagggaggaagggagcactttgaaaaaggcagattttggtttttaaattatgttttagtttgtgataaacaatgccgtgtctcttttcctctcttggttactcgctggtggtctcagggtggaaattcatccctgcttctgggcaagcaaccctaccgaattattacctcctctctggtgttaggctgcaacagggaccaacacctctgtgctgtgggacctcccaccccctcctgctccatgctctgtctcctgtggcctgacatttccaaagagcatccccaaaaaaggcatttcacaaagtgtcttccgggatatgagtctggaaggtggagacacgctctacagcacgcagtttccctgattaactaacttagaaaacatggccaagtacattcacagtgcacattaatctactaatagctccaaagagcactgcaaccaagatcttttcatggagcttttctagctcaacattctcctgacttcttttgccactaccactaggtgctcaatacctattagcatgatagagtgctgttccccccacactcactgggaaatgtgcttaaggagaattagggaggcatctctaaagggcaatggtcatttggtccaaccctgaaatcacaccaaggaagcaggtatctgtgttcttattaactggaaagccagccctgtcctgtcagttctcaaaggttaatttacacatgatatgttctttcactctctctctctcagatacatacacacacacacactctctctctctctctctctctctctctctctctctctctctgtctctctctctctccagggcatatagattcaatctttcctccaaagaaaaagaagaaacgatgacagcactttggtatagaaaggtgtgggcagcaagacacccaggtgccgaggcaagagactgaaggcacaagctgttccagtataataaagaaaataataagaataagaatagttatactagaaatagaatatagatatgattatatatgaatattattaatcattagtttgtagaattactctttgttctgttattataataatccctattctagaattataacctaggaataaccaggccatacggagttaggagctgaagggacacgatgagaagtgaccagaaggtaagagtgtgagccctctgtcacgcccagataagcgcaactagaggactccttggtctagtggtaacgccagtgcctgggaaggcacctgttacttaagcgggaaagggaatctccttttccctggaggaattagagaacactctgctccaccacttcttgtgggagtcctgacattagccaggcccacacacagccattcagaagcttgaacgtctcccagtgatgctgtgcttcagcagtcacgctcctggtccactttcatgttccgctctgtacctctggctcctccttctagataacagtagcagaattagtgaaagtattaaagtctttgatctttctgttaagtgcttagaagaaatgatgacgtatgatgtatgctgtcctctctctctctgcctcggctgccataaagggaaaggccccctgtatggtggacacgtgactcgtgtgaccttatcaatcactggagatgactcacacttcttgccctgcccccttgccatatatacaataaatagcagcatggccaagcattcagggctactaccagtctccgcatcttggtggtagttgtcccccgggcccagctgttttttcttctatctctttgtcttgtgtctttatttctacaatctcttgtctctgcacatgaagagaaaacccacaagccctgtagggctggacactacatctggcgcccaacgaggatttctctttcattatgtgaaggcgcgcttcgagcatggaacacagtggagagcatcaatgacagattcctgagaactgcagtcaatacgcttggtggtaggcttgggcactcagagtatccccggacaccatgggacaggccagtactaagtactcggcttatttaaactttataaaaactctccttaaagaaggaggtgtaaaagtctctactgataagttaattgcagtgtttgaggtcatagatctcctctgcccttggtttcctactgacggaactttagaactcaaagattgggatgagattggccaacaattcaaaattgctcataaagggggaaatattcctcccaccatttggtcaatctgggctttggttcactctgttctagagtccttgcagactcaggagaacaacatggagactgacccctgtttcctgtcctctgaggaggttgaggaagtcctcagttctctttcccctgaggaaactgcacagattgaggccgtcattttacagatgaacctccattctgacattcctttgaccctgccacctacaccagagcctaccgcgcccccattatcactttatgatgaacttttacatgatttaaataatctcatttccccaaaccagagaaatccaaccgaaatacattctcaacagctgttgtaactggaccctcctgtctttcctcagacctgctgtagggcccccgaccttccatctgcgcagcccgaaaatggctctaaactacctttctatggagcccggtaatgaggctctcaattctgtccctgttcagccctgctgtagggccctcaaacttccacctgttcagcccggtaatgaggctctcaactctgtccctgttcagccctgctgcagggccctcaactttccatctattcggcctggcaatgaggccctcaaacctgtccctctgcagcctgattatccatctctcacttttgtttctccttcagcaaatcaggctcccttgaagcctcagggtcccttgaagcctgtcccgcagttaccactgcagcctggacctcaggcccctgaaggacctgcccagcaggtaatctcacctcaacctggcttacaggttctcaattcttcctccgttcaaaatcctaacttcgtttctccttctggtctggtcactactgccgctcataagcaacaagttacatacatccctcaagatgatactcctcttatgagagccatcactcaggccagagaatatggggctcctgaggcctggcaatttcctgtaattttacaacctcctatacctgccgtccctgcagcacaaaatcagccacagcccgctgaccctgctcagcaggaggctgaccccgcggctcctcaagatctacagcctgagaatcaggtccctcagcccgagaatcaggctcctcaggcaaataatcagcccccacaactgcctgctgctgtggcacagccagttccaggtatacatccaggcagcagtccaaccagatcctattcatccaggccaggtttggctacgccctgctacttgggaaagtttttcttttaaattcctcaaagatttcaaagcatcagtgaagcagtacggcaccaactccccgtttgttcattccacattaaaggccctagcagaaggtaaacgtttggtgccctatgactggaaaattctagcaaagtcagtcttatttaaatcccaatatttacaattcaggacttggtgggttaatgctgtccaggaatgcattcatcttaatcaggtctctaatcctcctgttaatgttacggctgaccagttactgggaatgggactatgggatggaattcgaaaccaagctatactaaatgatgaggttattgaacaattatgaaaatgttgcctagatgcttgggataacattcagaatgatggtaaaatatgtccatcttttacggctgttacacagggacagcaggaaccctatccagactttattgcccatcttcaagatgcgacagagaaaaccatccctgatagccacggccaacgacttgttgtagaacttaaggcttatgaacaaacaaatgcagactgccaagtggctattcgccccattaaaggcaaaattccaccaggaggtgatatactcttctacattaaagcctgtgaaggcgtgggggaactctacatacagcaatggtcctggcacaagccatggccactattagaatgcctggacgattctctggcaaatgctttcaatgcggccaatcagggcattgtagaaaaaattgtcctcggctttcaggctgccattcttttcaatgccaacaacaaaaccctatacagcaacaaatcttgccctccagtctgtgcccacgatgccgtaagggaaatcactgggctgctcagtgccgcgcaaaatttgacattgatggtaaccctttaaagccattcagcaactagggaaatggaaagaggggccagccccaggcccctccaaacaatggggaattcctcaactcacagcctttggcagccagccagatgagcactttcccagcccaatccattcaacctgccccccagttcccacttcagccatttgtaccacaggatctaacgactcagtcccaacacaaatctcagtacaatgcttgtcccctgccaccacaggctcagccactgtagatctctgctgcactcgagatatttctctcttacccggagagccacctattgctgtttccacaggtgtgtttggccgtttgccacctggcactgtcagcttgcttcttggtcgctcaagcctaaatttaaaaggtgttcaagtacatactggtgtaatcgactctgattattcaggtgaaattcacattgtcattagctctgcagtatcttggtatgcagcagcaggagacagcattgctcaacttcttatactccgttacattccactaggatctagttcttgtaagagaaccagaggtttcagaagcacagactttcagggcaaaacagcctatagggccagcaagatttctgatactcgtcctgtgtgctccatgcatacatattcaaggaaggaagtttgagggaatgattgactcgggtgctgatatcaccattatagcctcatatcaatagcctagacactggcccaaagaatatgcatccacagccttagttggtgttggtcaggcttcagaggtttatgaaaattccactattttacactgtacgggcccagagggacagactggtactgttcaccccctcattacgcctattccagttaatctttggggaagagatcttttacaacaatggaggacacagatttctttcccacaaggtaattacagctaacaaagtaaagacattatggcaaaaatgggatttgttcaaggtatggttctggaaaaatcagcacaaggtattactgatactattataactactcataaatctgattcaacaggacttggttgttctttttagaagcagtcactatcaagcctccagatcccatccccttaacttggaaaactcagaaaccggtttgggtagatcagtggctgctccctaaaaataagctggcggcactccatattttggtccttgaacaattaaaattgggacacataaagcaatctttttctccttggaattcacctgtttttgttattcaaaagaaatctggtaagtggaaaatgcttactgatcttagggcagtaaatgctgtccttcaacgtatggcaacccaacttgccatcccccactatgattcctgagtattggccatttatcatcattgatcttaaaactgtttctttaatattcctctggccccctcaggactttaaaaaatccacaggccctgtagggctggaccctacagaagggtacataatttcatgtttcattagagagtgctttttaaggccacttgttattttatagctttgcaaaattaagtggtgaaaggaagaacactttctcagagccctgcccaccaaacccagcgagcctgcactgcgatgcccatcacatcccaacagatgtcacatgtccagcatttgcctgaacccctacctcacagcctgttgctgccaccactcccttatggcgcatcacacagctaagagatgctcacagcccccacgcagctcagctggcgatgtttcccggagctatttttccttattagttaagcattattttaccaaagccatgagtcataagactttaaacatctgcaaatctttgaggtctttgaataactcagttttccacgactatcatcaaactgtggaacaatgagtgaaaaatgtattttgttcataaacaactcatcctcattcataaaaataaagagccagtgtctcatactgtttgttctccacagctcatatcaaatgacatcataaatttctgtcaaccaagcccactggaacacagtgaggtgaacacacccccacttgtgaacagctgctttagttctttccttccctgaaacaagagtagagggaagacctcagcctccaagcgtagtgaacaggttagcaaatggaggcccatcactatcaagaaaatggttttgctagagtccttatcaagtggattgtgccagaaagaaagtgatcatcataggagtaggcaagtcagcctcgccaactgtacaggacatgacctttccatttcctgatgaacccggaggtgtaaggtcacacccatagcaatggctcctctcgtaccaaaagcgcctggtaaagcacactttctggacaccggatgtgttcccagggatgccagagagctccctgtagccggtggcatccaggtggacagacttacacagcagcacgctgtccctcgctacatcggtcagaatttagggacacaagctgcccagtgcacctccatccatcacctctcttccccctcttcttgcttccttcattattcaacctcgaaataaaaaagaaaacaagatgcttggtcaagccaatctcaactaccgagactttctacctcacactaccgtgtacatggcaggaaatctcaacagaacaggggcgagaaaagactcctcggacagacttcagtggaccaggatctgagcaggatttgctcgccttggaaataaggcagacctcccaaggtggagagaatttaagtagaagagattcatgaagagaaaaatatcgcccagttaaagcatggccgtgaacaaacagccattttatttatttttctacagtcaaaatattagacacttgttcattcaatcttctcttttaaaattaatgagatatccattccttaatgtcatgctatgaatttttttctcagcctcaccccagttctttaatcttgatcactaaatagtagctttctagaggatgctttttttcatttgctaccagggcttcccctaatgggccggagggttcatcctgttaggaatctgtgtgtgtgtgggagggggtgtacgtgtgcatctgtttgtagtatgtgtgtgtccgttcatgatgtgcgcatgtggtttggggaggtgtctgtgtgtgtccatgtgtgtttgtatgtttgcatgcatacatggtgtgtgtatatgtgtgtatctctgtgtggtgtatctgtgtttgtatatgtgtggcatgtgtgtgtctatgtgtgtagtgtgtgcatgtggtatgtggggatgtctgtgtatacatatgtatgcatgtttatgtatctgtgtgtgtatgtatttgtgtgtgtggtgtgtttgtgtggcatatgtctatgtatgtgcttctgtatgtggtgtgtatttgtgtacttgtgtgtatgcatatctgcatgtgtatacctgcatgtatgtgtgtatgtgtagtgtgtgtggtgtgtgtatgtgtacctgtgtgtttgtgtgtggtgtatatgtgtctctgttaagcagatgtctttgtcctttcatttttcagatcttcttatgctctcaacattactgccaacgtgaaaatgaccttttattattaaccagcttggtcatcatttttccccattcgggtcacggtgtgtagaaccggttttccatctcactggcatccacgggagttagcccttccccggtggatctggacatgacacccccactcccatctcaaaccacctgcgattggctctatgatagacgccaccattaccacagtaaaaataaaacaatggagaggccattacttaggtccctgaagcccaaaacaggccagtacacttttacctaagtcttcatgagagccaagcacctccactcacagcgaaaggtctgcctctcccgcacagcctaaataaggaccctgcctctgcccctctggggcgtgcagagggtgggagggcactgagcagcacccacatcacacccatgggtgctttctcatggaagctgggcttgccaggaccgcctgttctccttcagacagcatctgccctgccgcagcccggagtgagaaagcagccgagcgggaagcgggctttgagcctcgagacagactccatctctcttgtttcttacatggtctcctgctgcatggcctgaaggaggggcgccagcccaatggctcccagcactcagtagtgtcagcagctgccagggcccagtatggctcaaaatcatgccctgccaggctcccagtacagctggtggggcagggacccttcccaggtttcggctgatgtttcaggccactggcagttcttggagatgccttcttaaagccagaacaggcttctctaggagaaaaaccacagttagactattcatccacttcatttgacagtgacattagagtctggctgtcactgtctccctgcctccccattctcagcctttggagagtgagtacacaggtgagtacccaaggatcaaagtacactcgatgccctccagcagctcatcgctaacatgcaaatgactttacaatcaaaacatgtgaatgcccagagcgttgctcacatgtgcaaatgcattagcttgctgtgatagaatagatgcatactatgttacttttgaacactttaacggaagttgcatttgcataatattttatagctcacaaagccttttcaggtaaattttctattttaagtctaaaaacaaccagctttagagatagttgctattattaactcctcattttacaaatgaaaaagccagtaagtaggctgactgctgactaagtagacagcaccaaaaagaagcagcagactcccatttcttcctagaacatcgctggttctcaggcccaagtgcccattaaaagcagcaatagccttaacagtgctggtgcccaggctccattccctgagagcctggtgtaatgggtctggactggggccagagaccaggcactgaaaatctttaaaagtgtactgggggctgggtgcagtggctcatgcctgtaatcccagcactttgggagtcccagcactttgggacttcagtcccagttcttcagattgtgtctgctgtacctccatagagctgggtgtggtgatcaggccaagcttcaaggtcttgttttgcatgccggtcccatgtctccagcatcccctgaatccagtgacacctagtcctccctgtcagcttctccgccagtagtagtctgatagggctgccaagacaaagcagtgcaaacagcagacattcatggtctcagctctggaggctggaagtctgagatcaaagtgttggcaggattgattccttccgaggcctctcttcttgacttgcaaaggcctttctcctgtgtcctcctgcagtcctactcctgtatgaccttatcttagcaaattacatcagcaaagttcacattctgaggttctgggagttgggactgtaacatatgtttttggcagggagttgggggcagacataattcatctcatatcactgtgcggatggaccctgtccttctgtgcactgcttcatctcaagtgcctgtgaatggcatacccccagtggacccagattaaggcctcactcctagctcagagaggattctaggtgactgagtgtggttggttccctcagagctggaccctggggctgtgcagcaagttggtgaagatgccttctgaagacctagggggagcaggaatgaggctggggccttccaggggactggcttcattggtcttggccttgggtggcccctgcacatcaggaggaggggatgcacaggcccgcccaccctgagtcattctgggtaaagtggtgttgaatcgtgtgccctggaaagatgttgaagtcctaaccccagtatctgtggatgtggccttatttggaaatagggtctttgcagacctataacttatcttagatcaagttaaaacaaggccataaggtggtctctaatttagtaggactctgtgtccttagaagatggggaaacctgcataggcatacacactgggagacatgaagacacgatctgcaggccaagaagagaggcctcagaagaaactcccaacttccaaactgtgagacaatcaacttctgtagcttaagccgcccagtccccaccaccagaaagtgaatccaggtattgacaggaagccccaggtcggctgccccaccatgctagccatgcccccacctccccgggcccctgaggtaagtgcacagggagactccggaaagggggcgaaggactccagggctcacagttcacacctccctgtacctgacaattattggaatcttattgaaaagcagattctgcctcagtgggtcataatgagtcagccaggttggagggggtccctcgagaaactcctaccagcctgtccactgaggtggagcctcaggaagttcatgatgtttgcagctgggaggagcctggcccttcctcttcgtgtgcagaacctgagatttgaatggcagcaggaagccctctagcagggactctggcctcgcaagagtcctcatttcccccttttcttcttttttatccagtaaaaccctgctttactcaccctctccaactgcctgcaagcctaaattttcatggccgtgggacagacaaggacccagtctttagctgaactaaggaaaggtcctgcaacagtggaggctggggggctgcatttctctcagctcttgggtgatgtagatggggccctacctgactacaggcactgggcactcacctgtgaaagtccatgaggctggctcctggttctgggctgtggcctggcagctgtctaaagcccctgggcaagtcaaatgagcagctggtttgagacccagggccttcaggagggagacacttccaggggttcaggtggtaagcactccagttctgtggggcctgcacctcctccagtctggggccatttgtaagaatagacaaatgtgaatataccaccactcaggaagctgcaggagagaggttgcggctcaacggcctgtggccaaaatgcctcacttattctcaaatatatagagccccacctccagcagaagcacccctgtcaaccctggcctctggcaggaggtccagcctatgacgtgatgctgcaagttggtttaacatctcaccagaagaagtctgaccagagcctgaagctgaggggagcccagcgtggcaccacgtctcccgctccagcgccgtccctctggccaccagcccaggtcacaagcaccaaatatatattcatgtgatcatacatcctaggaagaggcagaagagggcccccagcctgagtgcttttagctgtacaataaccctcccatagccatgaggcagggccactgggaggagcactcaggactgagccgaaaacgttcctgggttctcccagagcctgagggggggtctgctcattagggccctgaattcttctggtgagatgttaaaccaccttgtagcattacgtcataggctggacctcctgccagaggccggggttgatgggggtgcttctgctggagatggggctgtgcaggtgtgtacagctgtgcacatcttgggccacctggggcaactctgctggatcacattagctccagagcccctgtgagggtatccaaagcttctgttcacttctgctgtggcaggcatggacgccaggggctgtcctggatgaacccctgatctccactgcctcccagagccagcttcccaggaccagctgccacaagctgcttccagctctgtggggggagctggacgctcacccattttgtgctgtgtgctgtgcgttgcagttgggcgttgactgttgctgggttagagggcacatatcctcactgaaaatgatagcagctgcctaactgtccccaggacaccgccatcagtccacaagagcacccagccccatgccctcctgctctctccaccacttggggtccgctgaggcccaagagaggagaagaaacaactgtctgccactacagacacccaagcctgcagggtcagagtcacacacaggtaggaggggagggcagtgcagcccctggctctgtgtacagcggtgtggaagtggggggtgttgggagaggacccagccagaactcactgtcccgacacctcagtcctggtagtagcagctcagcagagccaccttagcaatggagctcaggagggcatgatctcagagccaggggcctgggccacccgccctgccactctctcctgggtgaccccagctgcctggtccctgcctgcagggcgtggggagcatcacccacgtgtgtagccaagacttgctcatctctggcctgtcgagatgaccaggtcactgcaaggcaggtgggagaattccaggtgcaaacattgtactcgaagtgtcctatccctctgccattgtttacctctgcctagtggtgttggggctgagaaacactggcctgtgaggatgtctgaattcagagactctgattcagccaatctcagccatggctaattagcatcaataaatgtgtcttattgtgggtctttcctgacgactttcaaaccagccagtctggcaggacaccatgccacttccctccagagcagaccaagcccctgttttctcccccagccccaacttcaagcctgcatgggccccagggtgcccatcgtcagccagagaatcaggatcttccgagtcacctgactttcatctcttagcagctgtataacatcctagatgtcccctcataaccactctcctcggtggctgggacaggtgcccagaagtcacctggatgggggtgggggatctctcttagaagccagattcctccccctccatgctcgggaactgccccaccccatgcagactccatgggcttttcagggacaggacccatgaagctgcccacatggaggcatggagctgtgctgggacccggggaggccaggagggcaatgctgggctctgagactgccctgctgtctgctgaaaaacctggtggtccctgtgaaaacaacacccgacgcccaacgtgagaccgttcctggggaatgggcaggtgaaaggcacaggtgggtgtttcccaaagtccctgctcaaaaaacagtgacagaatgagggtcatatctgcccagggccatgtcccaaccagcttccgctccctgggggtcagacctgtctgtgtaggtttgtccagacagactggtagaaagatcaggccaggtccagctggcatgttctggctctgtcctctaaccctgcaaggccagggtaccccaaggtgggcagctataatcccagagctgcccccaccacacaagccccatggacggagctgcatcgctaagtcccactccacccatgttgcctggtgccgtggggaggagcaaaggagatgctgtccctgaagtctgaccagagcctgaagctgagggaagcccggcgtggcaccacgtctcccgctccagtgccgtccctctggccaccagcccaggtcacaggcatccagcaacaactgcagcatggactctgggtctgttggatgtgggcatggctgctggctcactgctaagtcagggaagcaccacgtggcccacgctgtgggcccctccaaagccactgtgttccagcccagtgcccagccccaagtaccgtgttataatgagcggcgactgacgtgacccaaggcagcctcccatccagagctcctgggcccaggatgtgaatctcaatccctgatgagtgcttattcctgaagccccaaggtaagacaagggaccctgagctctggggtttcaccgtgtagaccccccagggctggggtttacataaagaatggccatcctcagggtagttcctcaagtaagcagtagtggcaaatactgcccactgctgctgcactctctctcacttcggggggttaatttccttggtttgggaattaaattggcttgccaattttaaaaggcaaacattaccagaaggacagagggaaggaaaaagaagggaaaggacaagaagtgggggttggccatggagccatgtccctgacatggggtgggaaggcctggccagagtgctgctctccagggcaggaaggaggcagcttgcagggtgcctctccgcacggggacggcccacttggggcagacaactgagagttggactgcacagcagctcagggctacttctcaagtgcccactagatggcagccaacacctgggcatgagctggtcccagccatccacctggcaggaaagggacaggctacctacctcctaggttatgcctatttttatgaaagtggaagagacaccaactgcatgcacaattggaatcgcgtttcaacaggtacagaaataatgtattaagtgatttatattcaaaataagtgactggcaaatgactgctctattcagagaacccatatctaatctttgagatcacagtgttgtccagcagaggggattggaatgagtttctctaactccacttgctaaaggtcagcttggtgtggacttgttctgttagtttgacattgaaatgcagtcattttggagtctttggtctccgaaggtgggatgtagcgtgctttagctagaagggagccttcgcccaggcctgctagcctccagcctggagtccttgggctgttgggaactgaaggactcgtcacacttttcccggaggcattccggatgacaggagtgctcaggttccccacctggagcttgctagtccaggctttgattaagggagatgtgaaaacaaagtaatgaatttatgtactgctgaatcaatatggtgtggagggaccctaccttacagaatgtagggtccaaagaggtgacaaaagaatctcagatctaatccagcctctgctttccaggtgaggacagttaattttcaaaaatctgcaatggactgagagcagggatcccgtcaccacctgctctgagctccactgtagtcccggcctagccttctagcaccttcccagggggggcgccatcggcagtcttgagtagatcccacttcagggctggctcacagcttttcttgatttccagacgtgaagcaaagccaaaggtgagccactttcttgacacatccaaaagaaattttgaggaatgtcaaaaggagtgactggcggtccttcctgggtggtaagaagctatgtatttcttttttttctttttcttttttttttttttttgagactgggtctcactctgttgcccaggctagagtgcagtagtgcgatctaagctcactgcaacctccgcctcctgggttcaagcaattctcctgctcagtctcctgaatagctaggattacaggtgcatgccatcacatccaactaattttttatatttttggtagagacggggtttcatcacattggccaggctggtcttgaaatcctgacctcgtgatccgcccccgctcggcctcccaaagtgctgggattacagagaagctatgtattcctacgcatgtattctcactgcctttcagctaactgacaaggcggcctatggacagcaccaaacagaggtaagggacttacctgggcacattactgtgaagccaaacatgttgctcaatatgtcaaataaccagctccccatagttcttctgggaagttcccatccatgcccagggagatgactctgggacataaactatacactctgaatcagcctccaatcgatggtgttgtttgtcccatagccacgactcactggtccgggaatcaggcagtggaaatgggagatacaccactcaccatcacccctagtgagccactggcaacatttttgcttcctgttcccacaactttatgccctgctagcctaaatgtcttagctccagagggaagaatgcttccaccaggagatgcaacaatgattccataatttctacaacttccacaacttccaactggaaatgaagactgtcatccagccattgtgggctcttcgtgtctctgagtcaacaggccaagaagagaatgatattgctggctggggtgattgatcttgactatcaaagggaaattggattgctgctccacaatggaagtaaggaagagtatgtctagaacataggaaattccttagggcgtctcttagtattactatgccttgtgattaagctcaatggaaaattcaggaatgaaggtttgggtcactgcaccaggtaaaaactcataaccacctgaggggcttgctgaaggcaaagggaatacagaatgcgtcggtggaataaagtggttatagatacttactgtggccatgtgaccagttacagaaaccaggactgtaactgttatgagtactttctccctgttttgttaagaatacatttgtgtgtatgcaaagtaagcaaatatctttttttctttcctctcttattcccttatcctgtaacacacaatacattgactttatatgaatacttaagtattgtcaatcttacattatagtatttaaattatgagatatcaaggagaagagtaaacatcaccgaaggcccttgccttctcttgtggggaagggattagtgagttttgggttgtatgcaagataggcagatagcatgacattggtattgtctttatttgaagattagcatagtttaagaagatgccttttggtgttaagttgacaagaagtggacttatgatggttaattttatgtgtcaacttgcctgggctaaggaatgcccagatagctggtaaaacgttgtttctgtgtgtgtctgttagggcattttgtgaagagatgagcatttccatcagtagactaagaagatccactctcaccaatgtgggtaggcaccatccaatctgctgagggcctggatagagccaaagggcagaagaagggcaaatccgctctctctgcttgagctgatatatccatcttctgccctcggacactggtgcttctggttctagagcctttggattctaactgggactcacaccatcagctcgtccggttatcaggcctttggactaagactgagttacaccaccagccttcctgggtctccaacctgcagatggcagatcatgggacttctccacctccataaacatatgagccaattcctataatgtctcacatatctatatatgtcctattggttctgattctagagcagaagacacacaaccttctagatctgtagggctccttatgaatcatgagatccccagaacagctgcaaaattaaacaaattcagcgaaacaaaaattagctgttttgcagataattactgcttttacctttaactttcagttttgtcatgatgtagacatcactggagacgctggagctgaagttcgggccacggttgtcaaaggagagtaggataggctggggagggaggcacagcaaaccttcatggtctccatattatacccagtggattttcagatgctccaggaaggtggactatgtccatggattccagagcacctcaatttgaggatcttttaaaaatgcttttttactgtctgtgtgaaactgagcaagttgctcaacctctctgagctttggtttcctcttctgcacaagatattgatgatgataataataatactgaccttctataatatttgcacatcactttgcctctataagtaataactcttagcagccaccatttttccatggccttttgcaatgcgcagggtgtgaaatcttcctagacagaagcccgatatggattcttcaggacatgggttctgtataaccaaagcacccagatatgtgagggtaggacttagtggccagatgacctgagcctcctactgtgccttccgtaccacctgagccacagttaccgcatgtgcgtagttcactgtgggggtatgaaaccagccatgtcacagccatctgtggcatgcacctgtaatcccagctattcaggaggctgaggcaggagaatcgcttgaacccaagaggcagaggttgcagtcagccaagattgtgccattgcactccagcctgggtgacaaagcaacagagcgagactccatctcaaaaacaaacaaacaaacaaaaagtcagtgttgatgacagttgatgactgtcctccctgcatagggtgccccttcacttgtagctatttacccttcaggagttgtgctagaaaggcatgagctctttctaccacggagggcaggcactgccctgggcctggagtgtggactcccacctggaacagcctctgagtgcccagcccatggtgaccctgattctggcaatgccctacagttacatggcccagcccaggggtccctgtggatggagagccgtttgccacccccaggtccatcctgggaagccggggctgtgtgagtgtccctagtacttcagccttgttcttatgtgatctgcacggaacccgctccaggcttgccatcacccccagatggctgaggaccacctgttctcctcagccagggccagggctgaggtgagagaaggggacactggggcgtagcttaaggacactcacttgcctcacctggcctgggcctgccatagggatcaacccagccatgtgctttctgcccaggaagccacactgaggaaagagactggaggcaacccagcctgggtgctcgtcctttgttgcccatacaatgggctttcagcttcagccctctgtcgacctcgcagggtgggcttaatgtgctgtgcagtagggtgagaccctccgaggccggagtctctcccctgccccaagaccatttcagcctctgccgtgttcttgcatgggtattgtcagtggaagagagaaagcattccatggttggtgacttctggaaacctctgtggacttgcattccctccgttggaatgaagcatcttcaggatgcacagaatttcggcagcacggaaacctgcttgtgctcatttctcccggcatgtcctccacgtctttgactcctcacaaggcggctgtacaggcactttcccatgccaggcctcactgttggcctggcatgggctcccactcagcccgtgctgttccagcgagtccttcctggggcctgaaaccttagcccatggctccttccccacatagttttccctctttctatggctgacgacctctccctcgggccccagaacatgacgtccccactactttgaggctgccaagctctcgggaaacgggtcgctctgttcctctcttgggcctcccacagccctggaacagtctgggtgccctgggagggacccagccagcctctccttgctggctggactgtgtccaagcattgtgctccatgcatcccctcctggacagccttggctgccgtgctcatcagcgcttctaccagggcagtaaaggagaaggacagcaggcagagctgcactctctgcattggcccccaactcctaatgccggcatgagttggcttggccaaaatgaattgtttggatgatttttctgtatttgaagagccaaggaaaaagtttccattttgtgtctgtgtgtgtgtccgtatatacgtctgcatgtatgtctgcgtgtatgtctgtatgtgtgtctgtgtgtctaagtgtccctttatgggtctgtgtgtgtatgtacatgtgtatgtccatgtctatgtgtatctgcgtgtatctgtgtgtctgtatgtacatgtgtgtctgtatgagtctgtgtgtctgcatgtatctgtgtctgtgtgtctatatatacatgtgtgtcttatgagtctgtgtctgcatgtatctgtatctgtgtgtctgtgtgtcttacatacatgtgtgtctgtatgagtctgtgtatctgtatgtatctatgtgtctgtatgcccatgtgtatcttatgagtctgtgtgtctgcatgtgtctgtgtgtctgtgtgtctgtatgtacatgtatggctgtatgagtctgtgtatctatgtacctgtgtgtctgtgtgtctgtatgtacatgtgtatctgtatgagtctttgtatctgtatgtatctgtgtgtctgtttatatgtacatgtgtgtctgtatgagtctgtgtatctgtgtgtatctgggtatctgtgtgtctgtgtgtacttgtgtgtcttatgagtctgtgtgtctgcatgtatctgtgtgtctgtatgtacatgtgtgtcttatgagtctgtgtgtctgcatgtatctgtatgtctgtgtgtgtctgcatgtgttgtgtctcagcgcacaaacccgcagcacacagagctggccctgcccatccactgacacaggaaacctgagcctcgaaagcagcccatggcgcacctcagtgctggtgcactcaccctcttcagcctcctggttcttccacggagcccagctctggagcagcagagctcagggacactgtgttcctcctgtcctcacatgctgcagcccaccaccttgccaagctgtgtctgggcacgtttctggaacctggcttggctccagcactggccctgccagctctgtgcagacaagctcccaggagacgccctgggatttcacaatgagcctcgtgtgcccagtctacccctgccccccagctgctgtccgctgcaccttcctttggtttccagaccaggtcaagacatgggatgagcctgctcagaagggatgagcctgctcagaagccctgggccacacacaagccctggccagccacagtcggtgccctatgctcaaagagccacagcgctcttgacccagctccacattgctggccgcaggcacttcatttcttgtaaattaacccttctttctctctggaaacttcaaaaacttctctttacctttgaagttccaaaataaatctttttaaaatgcattctgccatgcgttggtgggcccttttaaataggactggctatctggtctgcagaacctggtgctaaactaaaatgtggaagtcctgttcaaaaagcaagaaaaaggcataacaatactaaaatatacagctttttcctctcttccagagtctctttcttgatgtgctgcatttttcatgttatttaatgtcattccaagttaaaattttaaagtattagcatgaattttatcatttgtgcaatgctagttttaaatgcaaatacaaaagtgtttaactcacatgaggaatcactgaaattatggtttgtgttatgtggctcgagcatgcatgtgtatttcatttctaccataacagcgacaatgctgctgaaaagtagctcaactgtttgtattttacttcttgctacatgcacgtgcgccagcaccctcttatcttcagctgactaatgagggagaaagcactgaaggacaggaactctgggttgccctgtcctcatctttcctcgtatgtcatcattttcaaagttcgtggttgtcgaatactggaagtagcccaggtaagaagggatgggataggatgccttcattgttctgtttcttagaaggcctttgccttctttaggcatttgaaacaagttctggttccaacagatcgtgtgtggctttgtacggcttccatatgcccctccttctgtggtagagcacgattaccttctactcgccttcagtgtcgctgaactgcaccggaatccactggaattctgtatgcatgggccttgggagcgtgaatggagcagcaaggaacggggacacatatatcacctgtgtctctgcacatgcacacggtttgtggctccgtcggacttcacttacaaaacccaagttcaaagatcaaattatgaagcatttcaagatggcaacagatgagaatcagacaagcatagagtccttctgagcttagagccttacgtgaccacaagggccacatatccaggaagctggccctgcttttgaactggaaaagttctgatcaattttcttctatcagttatttaattattttcctccctcaagtctctctgttctctcctcctggaactcctagtaaatacataaagaaacgtctagctcccgctcgtgtcaattgtctcttacttggatttctttgtccccatgaatgacattctacaagaaccccttggtctttcagttcactaatttattcttcaatcacgtctgttttgctaggtttcattaacaatcatcttttaaatttcaaagttttatagttcttttttgtaacagcctcttcttgtttcaaggatagtttacattctctaatcttctcaaacatgttaaatatgatcacctttaaaactttaaactgctgtgtttagctgtttccttgagcagggagagttccgtttgttgaagttgaatgccactgtttcgtagcattcattttgctgacatgtttgacagctctcatctatctgattatcttcctctttgagaatccctgaccagtcatgtttctccctgctcaagtgaaataaaggcctcaaatagatcagtggttttcaactctttttagcatagataaatgttgtaaaataaaattttatttgtggaaatacagtgtgtaaatccacagtggaaaggcaataattgaggcagagatgccctgcaaccctagaggtgcccgcttggacccttggtgttccctctgcagcctcaccacacagtgggccttctctgtgattgctgggctgagcgatcctggatcctcacagcccatgtctcaacagttaatgaaccaggtgatctgcacatgtatttcaagctcctgtattatccctgatgaggatatctagatttgaacttctttgaaattccttcctaaatatttattttgtcatgtttctacatatggaagggtcctcatggcagatagactcacagggacttacacactaccacactctttaatgggaacagacctcctattactgacttcttgacaaagtcttgaaaaagaatgaaaatgaggatgcaagtcaccagggaaggcagaggaatatttcttttatttaagcggacttgctgatttcaaaagaaccatttccagaaaagactgggctaagctccaatcttggcctccgtatataatgcaaaagtagatgctataaactagtaaattcatggcattcgatcataaaaaagaagaagagatgcattttctgttagaccctgaggctgtactttcccaaccgctgtgtagagcaaacaccaggtggggagatggctttgtggacatgcaatccagtttctaatccagaaataggtcagagcaccaatgtgaaaatacctgttgtttttaaataggtctgtgtgtctcagtgtgtgtgtgtgtgtgtgtgtgtgtgtgtgtgtgttttccttaagggcacttgagatgccgcaaagaaatgaggaagtggaagttttgaattggtttttcttcttttgtctagggatgatttttttttaagagtttctaagaggtaattgagtttcttcctcaggaacagtcagtttttcatgaatcaaatgtatcagtaataattttttaaatgctggattataacttttgaaagtttgcaagttgggagcatatttccttggctctgcgacattccctcctcttcctggggttctctcctcctaggaccctgggaccaagcactgcccttcaggtctttgatctctctgatctcataaactttgctctccttgtccttttgaataccttctagaagaatccctggatcctcctcgtcaaaagtccacatgctcttgggggttaccattgttccggataatctggagttttcatgttgaaaacaaccaccaccacaccaacacgtttttctgttgtcctcttggcaacttcagagccctgacaccgtagggaaagcgcttagggatcccatcacagttcaagggccagggccggtggcctctgccaagtgccaggccctcttatccctgagtgaagcactcacattccctaagaaggggcatagggaccagagcacagggcagtgagggaagtgctgtggggcaagggtggtggtgtctgaagacggctctgcctttacaaggcccactggagctttatgtctgcatgccccacagcagaactgtccttgctctttttcatgtttaaatttatggtgaggtaggaagattgcttgagcccaggaggtcaaggctgcagtgagatatgatcatgccactatactccagcctgggagacagaacaagagcccatttcaaaaagaatttaagggcctggcgcagtggctcatgccaataatcctagcactttgggaggccgtggtgggtggatcattgaggtcaggagtttgagaccagcctggccaacatggtgaaactccatttctactaaaaaaaataaaatacaaaaattagccaggggtagtggcgtgtgcctgtaatcccagctactcaggaggctgaggcaggagaatcgcttgagcagaggttgcagtgagccgcgataatgccactgcactccagcctgggtgacagagcaagactccgtcaaaaaaaaaaaaattaaggtatatagatgcacatttaagttatataaacacacgtacacacacataaatgcagcacctttcctaagtgtacagtttgttgaattttcacaaactgagcatgtccatgtatccagcctctgaagaagaacagtggatcacccgcactgcatatagaagcacaccacatgccccttcccagtcacaactgggcccagcattatcttgagttctgacagcatagcctagttctactggattttataccttgtataaatggaatagtacaatttgtactattctgtcctgcttctttggctcaatttactttgcaagattctcatacacattatctcagatcattgtagatcatcaacttcttatcaccatctggtagtcattccttggtgggaacagaccatgactcagttatacattccactgctgagggccagtcacatggtttcctgtacttattcctactagctggtgtgaagcacgatgcttccgagagtattttcaggccaaagaagctggtattgtccaaataatttaaggaacaaatgaggaagaggagatggagaaaaggagatgttggtcagagagtacaaagtttcagttagacaggaggaatcatttttgtgatctattggacagcatggtgattctggttataataatgtattatatatttcaaaattgcttttaaagagtaaatattgaatgctctcaccaaggaaaaatgacaagtatgtgagatgatggatatcctaatgtgcttgatttaatcattctacaatgcacacatgtactaaaccatcagggtgggtgtgctggctcatgcttataatcccagcactttgggagaccaaggcagatggatagcttgagcccaggagttcaagagcagcctgggcaacatggtgaaaccccgtttctgtgaaaaatatgaaaattagccacacatgatggcatgcacctatagtcccagctcctcaggaggctgaggtgggaggatgacctgagcctgggaagtagtggctgcagtgagccatgatcgtgccactgcactccagcctaggcaacagagtgagaccccttctcaaaaaaaaaaaaaaaagtacattgtacaccataagtatatacagttattatgtgtcaataataaaaaagtataaaagtaagtcagaacaaaaaccacaccaaacttcttcaacaacaaaaaagaaagaaatgaagcaaacctagcctcagaaaatgtgctgtttgatcagttttacccagatagcacaggagcagaggaaaagtttgtttctatattccttgggtactgcccagcttctcttcctttcagggcaggcagtgtggatgacgaccttaaaatacagagagctagtggtgtttgggaagttacccaccaagccccagccttgatttgctgaaagatctcatcagaagaggaaagagtgggtaggcaggattgggatggcggaggcaggcaaatgccttcattcatgggagcaatttcagaaacacctggatgctggactccacaggcatttctctcatctagaagactgtgaaaaacacatagactaacttgtcccactaccaggaagatgcaactaggttcccccatcctctcctccaaaacagtccccttggattcaaggtggtagcagtcggccctagggactgacgccagaaacctcagaaagacatcaaaccattcaaggaagttcaggaatgtgctgcacagaaacttctgacaggaaatccaatttccctatctagattgaaccctaaaagacagtaaatcacagaggtcttggaggttggagaattcaaaagtctggatgtttgtattctttagttggtgctaatgtaaccctgacattactgcttcagttgaatgaatattaactacgtggtattagctggtatttgcaagctccagggaatgcttccctcaagacagcagcattttgtaaattaattcaataaatacaaaagcaaatgcatctgtttaatgggggaggcgattaatgtttccagattcccctggcctccagctggaaatctggttgaattttgagacgtgatgcagtccatccctcaatgggcaatgacttgaagtctcaggttctggaggtattgactcacagggttcaggcactgcggtcctcgctgccaggtcccgtctgtgttcagggagttgctgatgctatctcccaggaatactccattctcatgcaggaggctgggtctcctcttgaggggtgttaggtggtaccaactcacccctgggccaacagcaacatcgatgacaactcaagctgtggcttcctctgagtcaggaacttgttgggcagcctcacccctgaggctgggcttcatctggggtagcaggtccaggcctcgcaggaacaagacaaagatgctcagtttcactacatcattcaggaagtgctaaccagtgcgataaaacaagatcatagcataagaaacataggttttggaaaagaaaaggcttactgttattcattgtgggcaatatacttaaagccaaaagaaaaccctgaaaaacaattagaaacactaagagataataataataaaaggcggcacttacaaaattaatataaaataaatagttttttgatatacaaataacaactctttagaaaatataatggaagaaaaatgccactcagaataacactaaaaaaccaaagtcctaggaataaatttaagaaatatgaacatgtgatgagaaggaaatattaagtccccagtgtgaacataaaagaagattatttcaatatataaaaatctctttttcttgaataaaaggcataatgttataaagttgtccattcttcctatgtactctatatcctaaatactaatagaatctattaatatgtccctgtaatggagctggagaaagtctaaacaagaaaagagatgagaggactcttaccaagtatatatgagtatttgttataaagcaggagttggccaagccagctcatgagctgtttctgtatgtcccatgagcaaagaatgttttttgcaattttaaagcttttttttttttttgagacggagtcttgctctgtcgcccaggctggagtgcagtggcgccatctcggctcactgcaagctctgcctcccaggttcacgccattctcctgcctcagcctcccaagttgctgggactacaggcgaccaccactatgcccggctaattttttgtatttttagtagagacgaggtttcaccatgttagccaggatggtctcaatctcctgacctcgtgatccgcctgcctcggcctcccaaagtgctgggattacaggcgtgagccaccgcgcccggccctaaagcatttttttttaaaaacttgtgtgtgaccctatgaggcccataaagtctgatagattcaccatctggtcttttccagcaagagtttgccaatgtctgttctagagcatcattagttataacagtctgataatggaacagaattagaccacacatcaaggaaataatacgcaatacagaaataaacagaaaccaatgacaactaagtgtatagactaagctgccatttaaaaatcaccagcctggccaacatggtgaaaccctgtctctactaaaaaaacaaaaattagccaggtgtggtggtgcacacctgtagtcccagctactcgggagactgaggcaggagaattgcttgaacccaggagacggagattgcagtgagctgagatcactccactgcactgcagcctggccaacagagcaagactctgtctcaaaaaagaaaacaaaaaacaaatcacttagaaaagatggcttatcagtatctcatcttggctcacctagatagccatttggaagaaaaaacaaaactggttccctgttctactactaactttggagaaatggagccttttcttagttccacacgaaaaacattaaaagaaagcattaacaactctgactacataaaaaccagtaccttttgagaaagaaaaatgccttaagcaaatgtaaaagtcaaataaccaactggtatttgaactgaaagatatatagaagaaataggacaaatgatttctttaatataaataagttcctgtgaataaataaaaagaaacaactccataaaaatgatctaaaagtacgaacgagctgtttatgaggaaacaaaaatgggcaagaaacatgttcaactcaaacacaaataaatgtagataaaattattgtatgtagtttttcttttatcaaaatgacaaaaattttggtaatgccagtatatgccatgaaaggcattctgaagaaacagtgttcaggctgggatctgaagggcgtgtgggagttatttgggtagagggcggaagcatcccagatcgagagaacactgtgtccaaaggcctgtgctgtggtggcatggagccttcttgttcaaagaactgaggggccatgtgcccatattggatgagacaagctggacatatggcaaaaacctggcacagaggcaggaattttgtctttgtgctaagagccataagaagtacttgaaaggagccaacaacatacccagaggcgtctttgacccagtctctctttcactatataaaaatctccatctttttctggaataaaaggcataatattataaaactgtccattcttcctatgcactctatatcctaagcactaatagaatctattaatatgtccctgtaatggagctggagagagtctaaacaagaaaagagatgagagggcacttaccaagtagatacaagtatttgttataaagcaggagctggctttataacaggcagttagagtgtgaggaattggggccaggtgggtttacatgcataaccttctccaagagcaggattgatttagaaagtgccgacttcctatctgctgtgtagatcaaaggtatcaatccacttaaagggcttagtttaacacacagcacatgagaaatgctcaatatatccttgctattctgatggctttccatcatctgtcctgctaagcaaagaagtccaagatgtactaaaagttacagaagtgataaagaagtgctaaaagttacagaatagtaagctttctaaagtcccacttgtgtaaagataaagtaaaacagaagaatatgcttgtatataattgtatatgcaaaaatatttccttcttgggaagcagggggtgaatagagattatgttaaactttgacacttaaaacctaaaaataacacgtttattgtagcaaccttggagaacaaagaagatcacttgttatttaaagtagataggctgaatgtcaaacgtgtttaggacttaaaggaaatccctttaatgaaaggaaatatggttccaagtaattaaatccatgggctgcctttgtgctgtagttagaaaataatctaatatggaggagggaaaggaggaagaaaggctgaatttcaggggcaggacagcaaatccgattccagctaatactcaccttccaggagttttttttaaaggccaatgaagaaattcctatcattaataataaagaacatcccaacactagcatttccaatttattgtgacctgttgcgcatagagacttactgactcatgagaaatgcacctcttttgaagagtcttctagatggatgcatcatttctgcactcaagattgtgttccattgtgcaaagagctactctaggcagcctagtggacatgccggatgactccacccatggtgcttccagcaagaagttagacaatggagtggggagaaaggatgctgggcttcctctggctctcagatcacccacctttattatgattaggaaattggaaaaccagccacaaccaaatgcttcaggaatacctcgccttaggagctagggaccaaaaagaggcccagaactatgagtgtctgctacttgctcatgagcaaaatggctgctccaagccctgctcttgacactcacagagccactgcccagaaatcaggacctcttgctaaaactgctgcagaaaaccaggacctctccactgtgcttcacaatggaaatggcagacacggcaaagcgcagcccccactcccttctgtcctgtaaatggcaagtaagtgcacctagtcaaaatgaaataaaatcaggcccagaatctagctgcaagggagtttggagaatgtcatttttagtattacaacttctgcacacaggctggagagtagaaagcgtgcagagctctggtccgccaggatccagtgcaactcagagtgcagatgcattgatttccaaacaagaattgctgtcaattgactgcagggtagaccataagcattccgggtctcatgggaccgcacttgtctctcttctttgcctgcgagatctcccccagctcctgtactcagcagtagtcacccctgcagtaggtactgtgaaggaggatgctgaggtcaaggaagaatcttcagcctcagaaatgtctttgattgtgaagtcacagaagctgcctgggtggcagactgcttgtgcactcctgtgcagatcaggggctgcaacccaattcttgccccacagcaggtcagtgagaaggcagacctacaaatcagcatgtgcttgcttcatatgatttgtctcatttaactggccagacagctgaggcttaagtggtgttatcaaaataccaaggctgaaataaatcaacataacagagttttagaacaaataatcaatataaagataattaaaagtaaatacataatctgaaataatttgggggaaataattcaggaacagaatgaagagggaaaccctcaggttctcctcgaaatattgtaagtgagtcagaaaacaggaccagtaatggcagaggcagaagagcggcaggagacggcggttaccccacagcagaacgctgctctgtgagaatcccccagcaggtaccccattccagctgtggttcgcctacaggcagtcagcctccctgaacctctgcagagggcagggatagtagatctgccctttaagacccatgcagaggtgctgaaatgacagtattggtactctggatacaatggaaagttcattagggctgatattaatggtagtcactgtcatattttcagttgctttcagcagtatttgggccccaggatactgatgtttgctcaatacatgagcctgcagaagtaactgggagcaaacacctgatatcagtattaagcatgtggtgccgagaacaatatgttacagaatactgcagacccacttaaatcattcttttgtctaagaatgtggggtgttcagtggataagtgagagtccatggattttgctctatggctgatgaaaggaacgtgatgtgtgacatttagcaccggtgtcaggaatggctctcctgttggcaaacttatttcgcacgtgcctattcatcatctatcctgggcacctcactcaggtcctcatgagtcccctgtcttctcagcaagcattacctctctactcagaccaaggccttgtgagggatggagggtcactaagatgcacttcctgtcctgaagacattgtcagtctcctggggaagacggacttcaagagaacaaagacgaacactggatccctactggatttggaggtctacagagagggctgcattttgtccagaatttggaaggtaaaaatggccagaaaaatgcagagagggaggttctaacccaaaggagctttatcagtcagatgttcagtatggtgctgctgtaaccaacagttcccttggaactgacacgtgtcatatgtttccccagcttatcagacacaggggccaggaacagaagcctcccacaagcccagaaggacatacttaatgcacagcactgattgctacagggaccaagatggggacttacaggtgcatttggggaagagggcactggccagaaggccaaatccacgcaaggtgtgggtttggggaggagggatgtgtcataacagagttcccaggaacagcctctgacttgtgcataggcagtagactgggggtgccccgagggtcaatgcccatagggagtaaggagacaggactgggtagcaggagaatttgagctgtggaggcccaaggaaaggctcagctgggggcacttcaggcttgtcctaatgcaccaggctagaccttcgtgcacctcctaaaccagccattggatgggggcagctcaaggatggggtagaacctggctgagggcaggccctggggagggctcagctagagacttcagtagcattgctccagcaggaggcggatgtgggtgccagccacaaaggagtgtcctatggagcactattgtctccagcacagaagaaagccaggggcctggagatgccaggctagagattctcaagcagtcattcttgtattgctagaaccacaggggcagaagatttcagaagtgtcgatgggtaatgcctttcctatgggcttgactgggatgtacactttgcataaagtatatattgtgagggtttaacaacacacaaaggacacctgcaccttggcaagagaaaacgtaacagtatgtgtaatataccatctgcttttcaggtgtgggaaaactgtatgcaaaaacaaaacccaaaaaggacctgaatttctgcccctgttatagtgtgatgtagcagacagacctggcatatttgacaccctgattactgccaacactcctctcttccataagacaaaattgtcagtaataatcatgacatgaaataaatatgcatgagctaaaatctgaacttacctaataaatatggtgcacctcacagttctaaccctatgtcgctgtctggaattttaaacacaaatgcagattccaagtggtcacactgaaggaactccgatgtgtttcttcatctttaccttcactgtgcagtcgctgcgtaggtcatatctgctgcatccatgcaggaacaggaatgtgtagctccgtagggctgaggatcccagcagtgcctgaagcaagcttgaatgatccagggccctgacaaacgtctctcatgatgcgcctgtggaagctcagtccatgtgtgtcagagatgaccatattgctgggagttctctgaactgacacggtgtttattaagttatcagtaatgactacatgctcacctgaagctcatgtacctatcactgaagctttggtaactgcagcaattgttcagaactctcaccagaaaagattttgtgggaaaagagcatgtcatgattgacattgtggggaattcctagtgtgcagtgacaataaagagcaggctcactggtgcttggttttattattgttttaaaatcccccacagatgatgagcccccttctagcctgcgccagggcagaccccttgctcaccccgtccttggtgctctgctgggatggcacttctcactgcccttatgttatttttttgcccccaagttccactgaattctggtataacatctccaaaatcgagcagcatgtctcaagaatgaaagctggaataattcagaacataaccattgtgagccaaagtctcccttcttggtttctaaagggatgagagagaaagcaaggatgtgtatgtgtgtgcaaatgtgactgtgtgttagacggcaatgggaactgaaggctgtggggacagaaccaggagaaagaggttttgttggaaacttgaattcagtaagcaatgtatttggcttccctatgccttgctttcctcctctactaaatgccagggaggcattgtgagaattaagagaaaatcttcatgaaggccttcagcactttagctgcctgagaagcaagtactcaataaaagctagctctgcaataacaaggctataagcatctctatgtacgtctcctgggaacaaaaccacagaaagacatcgtggccactaactggggagcccaccatgctgaccgtgagtctggcattgttccaccttgaaggcttttccactgagcatgacggagatgtgctgttgtcatggtgccacgacattaacctcatcccacacaagctgtggggcagtgactcatagcgacaggtggccaggcggtttacacaaggagggtgaggtctctcagatcttggagaattgagcattagacaggtacaagcacagtttaagtataaaatccatccaggaatcaggtccttacatttctttggaattttctacaactgggttatgaaactaaccatattatgatataaggcatttccagaatgcagtgatggtaataattgctatcacttattggacactgactacatgtcttctccagagctccacaccaagctttcatctttgtttaggtgtcccccaaagcagatgctacaacaaggactcaagagcaggtggttggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagagcaggtggtttacttgagcagtgatctgggaaacccaagcagggagaggaaatgcaagacagggatagaaaggatgccacaaagtgtgcactcaggaacaggtcactgctggggcaactgggctcagtgcccgggggaccttccaagtcgtgacctggactttgccctaaatcatcctaccataagatgggattctggggttatctactccctcttgtcactccttggctgaggatgcctttggtgagttacacaactggtacttctgggtcacctgcacacgtgcacaagctcccgaggcacccaggaaaaacctcgggcaatgatgcagagcaggctttgggtaccagcctgggggactaggagtcatggcctggtttgcagggaatcggtagagggttttggttatcctcaggttcctcccacttggatcaaaccctgctgcaatgtggatgggaaagactaagacaccacccacccccaggggaagtgggaagctcaaagacctcggcatttgtgttgctctgtggttctcggcatgtggtcctgatgccaagaaccacagagcaacacagactgagctgcctgcgccgtcctctgataaataacttcccctaacatgctggactggacgttcagcccctactggggatggcttggacagaactgtctggcttactatgttctctcttctagagtcagggtcatccatgggaaggatggaagaatctcaggcaagtgactgggacacttctgtgagcggggccatcacttagcagggtctctaaggggagcctagagaagtagtgatgggaagggctgcccagggagctctgccctctcactgcagtggggaaggaaggcctgggccaattctggaaaagggaagcctgtgacactggtgggtaaggggtcagtagtgtcacagtggggagtggggccccatgtctctgatgccactggtggggaaggtggacctggtgtcactggaggggaaggtgagcctgctgtcactggtggggaagttgagcctggtgtctccagtggggaaggtaagcctagagtcaccagtggggaagttgaacctggagtaaggtgaacctggtgtcccaggtgaggaaggtaaacctggatgtggaaggtgagcctggagtcaccagtggggaaggtggacctggtgtctccagtgggggaggtagacctggtgtctccagtgggggaggtggacctggtgtctccagtggggaaggtggacctggatggggaaggtgagcctggagtcaccagtgggggaggtggacctggtgtctccagtgggggaggtagacctggtgtctccagtaggggaggtagacctggtgtctccagttggggaggtggcctggtgtctccagtggggaaggtggacctggatggggaaggtgagcctggagtcactggtggggaaggtggacctggtgtcaccggtcaggaagatgagcctggtttctctggtggggaagatgaacctggtgcctctggtgcggaatgtgaacctggagtcaccagtgggggaggtgaaagtggagtcactgggttttctcctcgccttggtgataagggtccgcggataacagagcaccttgttttacagcttt

SEQ ID NO: 574 - DNA, 91825 bp, Homo sapiens
attttataaatgcaatcttgagcagtagacagattcctatggcctgcaggtgcccacttaccaccctgaaaggccccacgtgcctaaaaatagagaaataagaggaaataatttcatttactcacttattcatttcatcatttatttgtcaaatttatttgttaaaaatgtttcttacacatgaattaggggacagacagtagcaggtgttgggatacagagcggggaaagctgctcctgggataagcatgcacccagcactccaggagtgcagaagagggacatccagcccagaccagggtgtcagggaagcgggtggctgctgaactaagccctgaatgatgaatacgttgtgctttcccccacaacatgttcacataatgaccctaaggaatagttgggaggctcttgcagcacagaagagtgggcactttagagtcacgcaggtgtgggctccagtcctgacctggctgtttgccagctgtgtaaccttgagaaaatgtcaatcaaccagagtcccattttttttcatacccagaatcagagtaatcataattacctatacattgctctgaaaacaaattagaaaatatttctctttttttttttttttttaagatggagggttgctctgtcaccaggctggagtgcagtggtgtgatctcagctcaccgcaacctctgcctcctcggttcacataattctcctgccttagcctcctgagtaggtgggattacaggcacgcaccaccatgcccagctaatttttgtatttttagtagagatggggtttcaccatgttggccaggatggtcttcatctcttgacctcgtgatccgcccgcctcagcctcccaaagtgctgggattacaggtgtgagccactgcaccgggtctagaaaatacttctaaaacatctagcgcaataaaggattagtaatgataacgagacatacatatcaggtagcctctttggttaccataacctcttcccaccatcctggtcaaacactaggaatgaaaaatgcagggactggggttcccgaaactcaagactcacatagtgtcacagtcagtagagttgcagccaagtggtctttgctgcctggcacccctcagcaacgagccagaagaagaccccagcccagggagaggtcacaagatgccacccaccccttttcttctgtctgcggttgttctgcatcaaatcattgccttgttttgcacctctctggtgaaatttctaagcttcctttcagttctaaaatccaaggtccatgaagcaaaactcaaaagacaaaacacaaaagtcaaaccccagcaaaggggttcaaagtcatcattcctgaacttcactgtgaggataaaaatgtactcgggcacaagcttcttctaaactccgagctttcacacccgtgcatccacgcacagaggtttcactgcccttggacaccaaatgagcattccttggcttgaaaaccctcttaaggctgagagcgtccttttgaatttggatacataaaattgtgactatccaaaggaggcacatggctttgtttttccaactttagtgacacagttagctaaatggtgagctcttgaggactgggaccatgtcttttcacacctgtattcccagcccctagcacagagccttcaccactgaagcttgtggaacgaatggctgaatgaacacatctgatggtgttttcccgcagcattttctatatctctcctctaactcatgaattacactgcagttggcacaaaggtacactacatgccaaaatggactaaataacacgaagaagaaattcaattattaaaaacaaaaatcaaacatagtccccatcacatctttaggatgaaaaggggttagtcctggggcgggggacagcctggggtgatggaggttacacccttctgccacccctttatgaactggtgagcctggccaaggtacttactgactctgagtctgtctctccacctacaaaatgaggagcgtaagaatgcggctcttacggggctgtgctgagcaggactgcttgtttcagggatgaatgctgggaagggtcccctgatttggaagacctactggctcatgtctcccgaatacactccgattgtccctcttccagttcagttaacatcaattgttcatcgcagattgcaagggccttgcccatcgcagcaggattttgcaatccctccaggctaaattgcaattaacttgctctattggggctgcctaggagtcctgggcaagggcaggacctgaagcctgtcacctgagcagtctgagtcactgtgcccacacctcagtcctgccccagggcctgcacaggttaccacttccagtggcaagccctgaacctccctgggactctgctgtctccaggatgacctggacacaccttcctgtggcacatcctggagcctgttggtcctgggtgacagtcacaggagcaggtaaaaagtggctcaggagccttagggatggctcttcagaggacggggcctgctggtgccagtccctcatcggagagaggatggaagctaccctcctgaccaggactgggttccctagtatcacgtgaggagcacttggcatttttgaaaaagactttcttttttctgaagcagggtcttgctctgtcacccaggctggagtgcaatggcacaaacatggctcactgcagtctcgacctcctgggctcaagtgatcctcccacctcagcctcccaagtagctgagaccacaggtgtgtgccaccacgcctagctaatttttattttttgtaacagatggggtctcaccacattgcccaggttggaggtcacactttattgcccaggccactcttgaactcctggcctcaagctatcctcctgccttggtctcccaaagtgctgatgatatagtttggttctgtgtccccactcaaatttcatcttgtaactctcacaattcccacgtgttggggcgggggggggccaggtgggaggtgattgaatcatggggtcgggtctttcttgtgctgttcttgtgatggcgaatggatctcacaagatctgatggttttaaaaaggggagttcccctgcacaagctctctttttgcctgctgccatccatgtcagacaggacttgctcctccttgtcttccaccatgattgtgaggcttccccaaccacatggaactctaagtccaattaaatttctctagtaaatttcccagtctcggatatgtgttcatcagcagcatgaaaatgaatacagctgggattacagatatgagccaacgtgtccagcattgactttattttcttagaaccactttaggttcacagcaaaattaaaaggtacagagaatgcccatgtaccacctctcctacactcaggcacagcctcctccactaccaacaccccccaccagagtggtacatttgtgacaatggatcaagctacatcgccacattatcatccccacagccacagttatgttacggttcacatgcacattctatgggtttggacagatatacgacgccatgtgtccagcattctaggatcataatttccttgccctaaaaatcctccgcagcacttccttttcattttctcctcttgtacgtgtggagggagagaagaaaaatgcattgcacgcctgctgtcaggtattttgctgagccacagttcatttaatcctacaaccaccctttggtcaaggaagacttgaaaacaaggccctgggaatgagtccgctgagatcccagtggccaggggacagttacaaggaagacctagggagacatgcagacgaattcagaatcaagctttcaagctaggtgggtgatgaggtctcatctactgaatgcagtgcagggagtcaagggaaccacaagtgcagggggtggggtatagccacaggagagcatccctgttcagacaccttcgtcctgggatatacctgaggccttcagaacacgggttcttgcctgggtgtggtctgctcatttgtattcatttaagaatcctgttagctgagcatggtgatatggacctgcagtcctagctactcaggagtctgaggcaggaggatcacttcagcccaggaggtcaaggctgcagtgagctttcattgtgccactgtactccatcctgggtgacaaagcaagaccctgtctccactttaaaaagaggagagagagaaagagggggatagagatagagagagagagagagagcgagcgagcgagcaagctgtaccttccttgtgcctggcactgtcctggtgctataggaatacaaacatgaaggttcccttcagaggtcctagggttgaatggggaaagtgacataccccaaaacacaagtagactttgatgagcacagagaatgctacgaaaattcagaaaatggagagattgcttctgggggccggatcaggacaggctggagaagtggatgacacctgtggcgggtcttgaagccagtgggtggagaagggaagcctggtcggagccacagatatgcactaggggcgggactgcaggcaggaggcagagccgggagtgcaggtccgggggagcggcattaccgagggaacgatgggaggtgcagggcagcactgtccagataggagtcagacagtggggtgtcgagctgggagcttcctgaaggtgaggacctacctagtgtacagtggtggcagacacttgattaggttggactgctgataacgcctcttgatgttggggtgagactgaacgagagcgtggggtgcccataataataacggggggcaggaggcaacctggagaggatgggttcctcttagacccactgaatgtgataggccctctggacggtcggctggagacgcaggactaaagcttgagactagtggggacagagatgctgacctgagaatcacacagaaagcagcagaaacgccggccatgcagatgtatacagaaaatggatagtgagaggacagaacccacggctcagaaacactcaagggtgtcccatcttcccacacttagctgaccgcagaaggagcaagagccaaggagtattcagaaaaggcggaggcttaggagttgcatggagtcgacatagttggagaaggagactaaacggtctgagatgcagttactcaccggggcagcgacgtacctcacaaaggtgaagatgagggtgcttccttccgtcaaggtgctggggtcactctagattgctcaagaccttgattctctaaggtttgaaggccggagtcggagtttgccttcagcagttttccatgtaacaaatgtgtgttgatacctgtttttgttccatccaggttcgaggggcgtccccagttagtgggtggaggctacctggaggccacctggaggccacctctcctctcccatctctatgcaccccatctgcacactcagcagatcctctagagacaggagaggcgggaggaagctgggctttatcttcagactgacctgttaagagccattccacgtaggcaaaacacatttctaatgcattctatgtggaggaaggcacatactataatttggcgaatttatcacagagttagaaatgttgttaagtgtacacagttcctcctcaggttcaagtcaaatgagctggcaaagagcttctcacagctcatccatgaatgccaaagaggagaggacgcttgctagccacggtggaggaggctgcgtcccgggcataaatgtactgagattaatccaggacacggcagtaccttctaaatgacacacatttgtagaacttgaaagtgggtaggctctgtaatgcgtcagtcactctgctgtcaactggcctggagcccagagtcggtgttcaataaatgttttcagaacaaataactgctttcagcacccacgcacctttttctaaggaaactcaacacagaacatacaaacagaaaatttcagctataactgattacaaaattctcccccctagctaaagacttcactgctgctttccttaaaagttcactgctaatgcctgcacaacaggcagctgaggtgggaggaagtgcgcctcacgcaccctgcaccagcccccgacccactcgtccacagcaggagaggcccggccccacccacccttctttacctgccatctttgtctggcttattcctcccttttactggttccatgaaggctttgtgtatgtcactgcagtatattcagtatttcctaaatagatcggacacttttatgcaaggagtttagtcatcgactttactaggacacggtactaatttgctcattaataaccaagcactataaaatcacacaccgagcacccgacctgacctcctgccctgccctccagcacaacaggctccgaaacgcagcagctgcagaaccagcgagataaacagggcggtgacgaagaggttcttactccaatcaacgtacagctgctgcctgctgatccaagggctgagatcactcggacagactgtgccgaaagccttctctgatactgtttcttaataaacaggtctcagcgtgtgcctgccagtcagtgaacaggtggaggaggagggaggcagagggatgacctccgctaggaaagagatgctcactgggatttcatctctcaaaagcatcagtattttctacaagttgaaaacattctttttcagacttgcaaacagggtttaagaaaccaactcacccaatttcccacccacctcttgaccaagttggaaaagaaaatccactgagaatgtctaatgtgcagcataactcaaaagtattttctatagctcatccgaatcataactaactcaaattaattgtgaaactctgcagtttgcctgctgctttcaaatccattcccagttaagagtaacaatgacatgtgaagagcatctgcaatagggaggcttgcaggtggaactggctgtggcaaggatggaggaaaaggggcgcgggtttgtgactacagtagacagcgggctggggcatcgcggggcctctgggaagagcatcagtctagttataaaaaggctgagagacgggcgcagtggctcacgcctgtaatcccagcactttgggaggccgaggcgggcaggtcatctgaggtcaggagtttgagaccagcttggccaacgtggcgaaaccctgtctctattaaaaatacaaaaattagctgggcgtggtggtgcacgtctgtagtcccagatacttgggaggctgaggcaggagaatcacttgaacctgggaggtggaggttgcagtgagccaagatcgcaccacttcactccagcctgggtgacagggcgagactccgtctcaaaaaaaaaaaaaaacataataataataataaataaataaaataaaaggctgcgaggcccttccgtaaaaggggaatgatgataatggttacctcctgggttgtttgaggactaaatgagttggcttatttgaagtatttggaataaggccaggcatccaagacttcatacaataataataatcatccattaaaattaacagaaaaggagagaaggttgctgcaggacaacacagaagagtctcttcagtggacaaatattttcttgggagcctaattttcctccttaaactgaaagaaccaaggaaagcactgaataatactaaaattaaagtatttttacccggtgaaataattcaaggcaaaaacagggatcatatgctactcattcttaaagtatcaagcataaaatgcagagtatttgttttgttgttctaatttccacttagatccagaaaaccaagtggactgaaaaacagacacagaaaaatgaaagctgagggtacctagagaaaagagagtctccacctcctttggaacaaatctgctctttgctgagcatgtgactccttctccggctgcccactcaattattaaaataattcaggaggggccaggagcagtggctcacacctgtaatcccaggactttgggagcctgaggtgggcagatcactttgagctcaggagtttgagaccagcctaggcaacatggcaaaaccccatctgtactaagaatacaaaaattagccaggtgtggtggcccgtgcctgtaatcccagctactcaggaggctgaggcaggagaatcagttgaatccagaaggcggaggttgcagtgagctgaggtcgcaccactgcactccctcctgggtgatagaacgagactccctctcctaaaaacaaaaacaaaaacaaacaaacaaacaaaaaacaaaatattcaggaggcctttctccggcctatgaaaacagtcatcaccacattctacattctctcagtaaaagctgcatgtgggccaggtgtagtggctcacacctgtaatcccagcacttagggaagccaaggcgggaggatcacttgaggccaggagttcaataccagcctgggcaacatagcaagaccgtgtctctagaaaaaataaaaacattagccaggtgtggtggcacatgcctgcagtcccagctgctggggaggctgagacaggacgactgcttgagcccaggagttcgaagctgcagtgagctttgaccaggcctctgcattccagcctgggcaacagaaagagaccctatctctgaaaaaaaaaaaaaaaaaagaaaaaaaaccaacatttgcatgtgaacaatcttccagtccagctgccttggaattcctaactccaggaactaccagctcccttccgcacctccctcctctggccttcccacccagctcctgcacccatgtctggcctaaatgcattccacctgcctcctaaatgcgcctgcacacattttggtatattctcctggctctcatttttactggtaaaggaagttaaaacaaaaggccaaaaaaaacaaccaatcagcatctatttatttttgaaagttagctccccttaggttccatgcattccacttctttctggatctctggtttcacaggcaagatgggacaggcagagagaacctgggcatgtgccctctgtggagaaagtgacttcagaaaccgctgaggctctattagcctgggattctaaactcggggggacatgaaaaactcaagagacgagtcatcaggctctatattcataagactcttctctgtgtgtgtgtgtgtctcttttcaaacaaatagcactgcgcagcatccttagagactacagccaaatgtccttcatgtattttctctacatttcaagaatctcgggaccatgcttcctatctaatgtgtgaccttgagagttaaaatcaaggggaaaaggtcaccgaattgggggcaagtttgagttcccgtcaccagccacaatctctatatcaaatggaggacaacacaccacctgggcctcagccaggtttgcctgaagcagggccaggcagcctcaaggcctccatggtaggctggggacatggggacgtggggaaagggggtgcagggaaactgggaactaggaggggagcgtgagaaagagggaataaatgcgtacgcggatgaagaggaacagcaggaggagatgaaggcggcgcacagggcagaacggcagacacagggctgggaaggtggcagggccggactccagaacctcagctgagcgttttcttctcctgtgtcccagggatggtgtgaagtgtctacaggcatccgagtgaacccaaagggagagtttggctggcacacggggagacgggccaaggcgcggcgggcgagggcggcacaagcatggcgctgcgacaccactgctgggagcagggctgaaaggtgtcttttgctgtaaggactttcataaggcagtcccaatccaaagactggctttaatttcacggccttagcctctcagtttcttaagccttctgaggacctcctgatcatgacaattaagtcactatttacagccatgtgacagataaatcagtattaggtgatttgttctgaaggacccccaaaaggaaacatatgagagaacccacactcggcacaggaacggcaagagtcctcctgtgagagctgagagatgacattggccctgagtctgtccactgctgaagcttggcagaggcgggggaagcgctcagaacagtcggctgccactgcttagtggaggggagggcgttaacgcgtttccccatcaaaaccaaaacacaacaaaaaacctctctgatttgggaatgtaatcatataatttctacttggcaaaaatgttggttggctatagaacaaaaagaacaatctgaatccaagctattgcctcttaatcctttaattaggctgagtctttcagaagaaagcaccattcattgttattgaagggaaccgagagcaaacggagatagtgacacacacacacacacacagatgcgcacatgcacacacacgtgtgcacacttacatgaatgcatgtatttgtaatgattataattaaactctcttgctgaagggctcagagtttacaaaaaaatttatttgtgtctgagagccacgattgagaacattaaaaaggtcctcctgggaatgtaacttgggggaaatgtggcgagagggcaggactcggcagcccatgggcatgccacaagatgcgcccaggcgctctggggtgaactctgctgtgacttcaggccagaggtgtctgcccccgcagtgccctgacagctgagtggtcggaaggccccggctgggaaggattcatttggaatctttcttcttcttctttttcactagcgtttcttctagtgtagcgtcctctgctatctctactggtttttgcagctttttcttccctctcctctttttgggcttcagggtgaagtcccggccctcaggcggctgcacatggtcccctgcatcctgagcagaggccttggaactctggtcccagcaggggcctctgagctgctcttctgctggcgcgctcttcttcttggccactcgctcctgggcctcggccctctcgggctttccctccgtgtgcctcttggccttaggctggaggtaactttccacatctttacctgtggcctctttatttcttttcttcccccttttacgttccacctgcgtctcagaaatgtcagaccctggaactggaacctggggcttgttcttcagtgctgccatccgcttggcaaagtactcctggatggtgaaggcgctggttgtcgtggtttcgttctcctctggagtggagggactggcatcgccctatggtgggcagaagagttaaaaggcaggtaagcatcaactgttcatccctcaccgcacccaggaggcacccacacccggcgctcacacctggcacccacacccggcgctcacacccggcacccacacccggcacttaggagacaaggctgagtgacacgctccctttggcctctctcccttctggtcggcctgaactgcaggccgggagcaaggcggccacacactccggctgggtaccaggtggggtggtagatgacaggcagaagctaatgtcagaagggagcaggcaagccgcctcgatggaattctgagtaaatgtctccctagaaacaagtgttgtggtgactaagctcccagaatctcccatcagaaacagggacactggtgttccagagcttggtgattttgttagacaccgatttcatcttcattatgggttacatgggcccctgtgttgatctagaaacttagacgccatctggataggttaaccttccatgaggacaggagccgcattccaccctggaacctggcttgccaggggcaccctttctcccccaaaggtggagcgtggccgctctggcagctgctcctgaagggagggcagagtggagactccgcgtgtctcagcctcctccctgaaccaacaggccagcttgggggcttctttccctcagctgggggtggggagtagagaaatgccccctccttccctaacaaaaactgtatactcgggactgtgtttgggctgtttttaaatgtgagttactcacacataacagctgggattaggattttaattttaaatgagtatatctcattgtcaggtaatatctgctataagaaaaaatgtgaaaaatgtatatatctaaaagtacattttgctgtaaagcttgagaagcgagagaaaattcctaaggggagaggctgggataaagaatgaaatgctggaatcgccatttgggctgaggctggcagtaaggtgaggaggagtgcctgtgaggcaggaagtgctttcgggttgaagactataaggaatatgctcggagtcaaatcaatgtctgcagcaactctgcccacagagactctggaaataagtcattaagcaatcatgctaaacttaggttttcatagtcacccaacttcttccttcatactcatttatctcacaagaagaggctgggtgttctacgctttcatgatgggagggtgggaaacggctcctgaataaagaaatctccaaatcaggattctactaatgatcctaaacttggctggcaaggttctgcttgtgcaggtaactgaattacaaaccacctataaacagaccctgtattgtctcgacacagtggtcctcaaaagccacctcagtggaatccaagataatgtcccagttgcagttccagcagaatcgatattaatatgtatcaatggacaattgggccttcagtggcaagtgcctcagacagctttcaccaaggggtacattaaaaaaaaaaatcatgtggtcaattctggaatttcaaaataggcagaacatgaagaataaatcaactgagttttgggaagcagttttaattttatctattactattcaatttgtgctggaattccatagggtgattttgagaaaaataaaaaaaatctgcctcaggagatttgtctttttgttcttcaaatgttgaaaaagagctgaaatgctgcacagcagagtgaaggatcttctcaaggctctcccggcacgagccaatcccaggctcatgaacaagaaagatcctgcctcccaaagacgggcaccctcacagccacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacacagagacaggctcggtgaccaggcaccctcacagccacaaagagacaggctcggtgaccagacaccctcacagccacacagagacaggctcggtgaccaggcaccctcacagccacacagagacagactcggtgacgacggctggctcgtttatgcaacagaagtctcactgacagtttcgcagcactacaggagcctgcagtctgtgggccactcttttggaatgtatttttgaggctggaactcagatctgagtcgaatcctatgactccttaccttgctcatctatttattaccttgtgaattcctgattttaatcaccggaactaattgctggtattaatcacattttttattatcaggaaatacaagaccatttttgagtcacttgttgaattcagcgggtcttcgtaactccagaaagtaagtatgctcatatgctcatcatcaacttctgggatgtaagtttaataggcacgggtcactgcacaggcttggcagggcatggagacaggctagagaggggccagcacccaagtcctacttcttcccagcaaagtgctggccacacaatgactggctagagagagctgcttaatgcgggggtagccaccctcccacatcacagaaacgtgcctattttacaagaccatggactcaaaggaaaaatacattgaaaatctgactcctgcaggagcaatggccaggactcatcttttatacaccaaagtcggagactcagtttcactgcagagattctaatcctgcttctgcattcttgaccatggcatcacataaaaatagatacatcttttcaagaaaactaatgcttttacatctggtctctatcaaagtaaacaagtattgagaaaacaagttacttttaagcattttgaaatgacaataacttgcattttcccacatttccattaaacacacaatacacctcaaaaaataaaataaaaaaaaatttaaatgcgacattcactgcttcataaacgttgagaatgtctgtttgctaactgtgtgccaaaacctaatgaaacaaatttaagagtaacttgaaaacttctggttccatataaaatactaccaagaaatatggttaatcatcttgccaaatgtgatttaagctcagggattcgggaaatgtctctctctctttttcaaattccaatgcttgctgttcagctaaaggaggtttttgccactaatggcaaaaaccgtgattacttttgcaccaacctaataaaataagcaggactggcctagtctgttcacagcaagcctcacagtcctctcccttccttcagcgctaatgagtgcatcacatgtgtcaaaaacatttgatgactgactttcccaaatggtaagtgggccttaatttctacccaatcaataagtacttgtggctttgaactgagatgactctggagcacctgttccccagttcacagagccctgagagtttaaagccaggcccatgggatcaccctgctcaatcatttgaggaagcttcacccaaagtgatcaggcctgggtgtcctgaggaaggcagctatcaccaccgtgccaggcacttgacatcaagtggcatctcagccaactcttgctgcaacctgaggagaggcgtcctctccacatcacacaggcagagagtgagactcctagcacttaatccgcagaaggtctcacagctggaacacagcaggagagagacagccctaaggctgccaggtgcaaagcccttgctccctgtaccacaggaccccgactcctagctcccacctcatggactgccttgtcacctttcctctctcttcagaagccaccccaaaactaaagtatgtatcaattgaccacataatccagagactaaggtctacactcacctaagttgactgatgcagaaaaaatatccacagaaatagtactttcaaaagagaaaaaaactacatcattttggtttgcaattcatataaataaaaaacagcctgaagccaggcttaaaagagttttataatttatcaaactagcatgtacattcacttgaaaaagtttgactgttttaaagcacagagtaaaacccaagtccaaaccttccacccaggcaagaagccctcttgggcagatgctggacagcttccacctggacactgccaatatggaaaggtggctgctgtggttctctgactcagtttcctcatcagcaacaggtcaattcaggtggttcatgggcgtacactgtgtgtcacgattagagctggagaatcttaacgccatctctggcaattccgaattatcactgaggagaaaacaaagagtgggcacaaaggcaagctgaccctgcagagagtccctgcgggtatcaattacaatacaccacagtcctctccggtccctgaaagatgcctgaagctacatgtatcaactcttctcggatgtctacagaattaaagtctgttctgcttcttttaggatcctccatctggagactctgcagctacatgagtgagtatctgcgcaagatcctctgggctcatggaggactttgctcttgtgtcattcaaacatgtatactgagatggattattagtacaatgcccaaatagagaggattctccattattctcaaaagaatcttttggggcaaggaaatgaagcagtttgcacagagaccttagtgaagtgccagaagcagatgcaccttactacagaatccccctacttatgatcaacatgccagtccaggaaatgggcttcaaaggcaagtctttcagctcgccagccttgctcatacatcactactgatcttaagtgacaggatgatggaagctttcttatttccacattaagacacggaggtcatgctgcaacagtaatccttcaatgaactttgttaacaaagtagactcccagagatcaagggtaatgtatttagcaactggggttgtgagccctgatggctattgcctgtgatgaacaaatgctcactgccaccacagcctgtctgtcatcagcctgtgctgggttagtctgtgaaaagttaagaaagcttggcaagtgagtggtttgacagaacattctgtaccttttccaaacttttcagtggggcagttctgacaaacacaaattatgtcttcatgtatcccttcaggtatgaagtgactgtgtgtgactcctcaaaacaaagggattgtggagaccccaccgtcagctgtgtgtgtactttaaactcctccaacagaaggggcaggatgaactgacccagtcactccctatgctggcctacgatgttcttccacatcccctgtacacagtcccgtgcatcactttcttgaagatcaagtgtgtgactgcttccttccacaagtccaatcccaagtgaacatcctttcttgtttattccccataatagcaacttgttgcttctattttctgtatttgtttaatttgctttgctagcatcttcccaaggaaacaagtttcttgaggacaggggccatttatgttgcatttgtattcatacaatccacaacctccctaatgaggaacaaggtacagtaagtgctcaacaaaggcacaaagacaccaaacccagctggaccaaggctgtgaagagctcccaccaccacccactggccccaaatgctttgtgtttgtcagtacgaacttgtctgcacatcaggcaggtctaatgtccagaaggggtgtgggagggtaagaagagaatcagcattttgagtgcagattcctcccatccacatgaaaccacccccttctcatcagatagcaccttcccttgcctcgtgatgcaaactgcttctctaactactgcagagtacatctgagtgtcgtctgctgtcagccagttccttcctggcccttagcaataaatagaaactcagtccagtgatccatccatttctccttctgctctgtcattccacatgttaccacagttgccttggaggggacaagtcaattggaaaaaagcaaggtactgtgtggtatgggaactgccacgttctttttgtgggattagttgaacacaagcaatgccagtagagactgaactgttcttgctaaagaagagaactgttcttggtaaagagaagagagttctcgtgcataccacatacaaaggtaagcagctcatttggagaacagcagtgggatggaagttccaccagcagcctctggtagcaagctgtgaaggcacagcctacattatatcttagctgaaaacaacctgggcaagctgattctagggagtcattgaaatgggtttgccactgaaggctgagctaggcagtgattcacggccgttcgttggaaagcctgccctgagccactatggcgggcggccctgctcttctctctatggaacctctgtggtttcatgcttttccttcgtggtttccatgtaactgaaaacacccagtgttttattgatgaacagctatttttacactcacaaaaagcttttcaagtgtgaaatcttgtacatttttcaagacattcatcgctcacatctggaattaggctaaacgcaccaagtctcggcaatgagcagcctcggggaatttgcctgggagacacaatcagttttagcattagcaagtatcacaagagtcaaaaacaaatataaaaccccattgactgaagagagttgtgatttgaagtggtattaaaaagcaaagatacaataacagaatgagaattatgcagcaactcaattggaaaacacagaaattgtgtgtgcgtgcacatgtgaaacaggtgtaagaacctgtggcatgtattagaagcccactctgcaggggttccagagggttctctctagaacagagactggtgaactatggccgtgggcctagtttttaatgatttttttttttttttaccatttctaaatggttaggaggaaacaaaaaactattttatgacatgtaaaaattacatgaatttcaaataccagtgtccttaaagttttgaatttcctcagtaaaaatcttgtaaaaatttgttttctttctcattatacaagtacatacaataggtgctaagtaaatatttactgaataaatgtattataaaatcggctctgtgactgtgaatacaatacggctgacttttggaagtggcaggtgcttttccagtgcacacacacaatatacctttatatacacacatgtacatatatacacgtatggaactggaggacgctgggctttgacaaagtcctcaagctctgtctcctgccaacgacagaatgcctacctttctgaactgtgtcagcaagcagcagagaggctgctaactgctgcctgcttttgagtagcaaaagccagtaaagaaaaaatttgtttaaaaagtgatgtgacatcaaagagcactctcagcaacccagtaagtatgcagagatacctttctaatatcaggcatcagaactccgcttggaagttacaaactcagacacaccggacattggagaagataatacgaactagaagggacagaatagcttggctggactttagtagagaaatacacagaatgccaaattcctcatatgaaggccaatggtaacagagctgttaattttatgtctttttatttttattttttcccatatgcctaaccagctattccgattgccacttattaggaaaagccgacataaacatgttttaaaaggatggttctctatggcaacagcttctcaagtaatcaacatcaggatcactgacaagagtcatccagcctctgtggaaaaagaggaaagagaaagaggagcaggcttcctgcctccctgaaaggccctcaggctcggaaagctgcagtgacaaactttcccgacacactggccatggaagataaacgaggctcctccagagctggagatgatcaatgtgacacaggcctcaacttctgtgaatgatgtctaaaaataatccaaattgactgcattttataattccaggtcaaatcgttctctcccctgctctccagaggcaggacaaacagctttgataaacagctgagacccagcactggcctctcacagaacagagcagaagcttccagagggttctgtctcttccatctttattccacaggaagaggtgaaaattgctgaagaaccatgacaactcaaatgtaggctccttactatagaaagcacagcagttcttgaagattctattaaatgtaaaatcttctaatttctaaaaagaataaggtcttttttttttttttgagacggagtttcactcttgttgcccaggctggaatgcaatggcacaatctcggctcaccgcaacctccgcctccagggttcaagtgattctcctgcctcagcctcccgagtagctgggattacaggcatgtgccaccacgcccagctaattttgtatttttagtagagacagggtttctccatgttggtcaggctggtctcgaactcccgacctcaggtgatccacccgcctcggccacccaaagtgctgggattacaggcgtgagccaccgtgcccagccgaataaggtctttttagagaataaaatattcattttgaaactaggaatagggtatgcatagttacatggaataattaagtagtcatgattgtttataaaagaaaggtaaattaggtgaatatagttgactaacaaaaaaagtctcgtctttcaattcttataaactacataaggctaatattttcacatactctttctttcaccagaaatcaatgtagcaaataaaaatatttgagaaatatttttaggagtaaatttggcaaagcaaagtcattctatgtttaaaagataccgaaattagtaagaataaataaaattccgaaattagtcatgttaaaagagtaaatgatataaaataatacatcagacagtgttcttatcacaataaaaaaaaggcaatataccggcacaacttatttttagcatagacaaaaactaaacaacaacaaaccaactacaaagccaattctactcaagaaaaaccctaaccagttacactgagactgtaattccaaggagctcataaaaaataaaaattgttactgctattaaatatataatcctataacctcttctcttgttttacacaagctgtaagtttttattttataaacaaaaaatatattgaaaacttaagtgaaaaagtacaagaaagactgtctccctgcatgttcagaatccaaaaaggttcttgaagcaagacctgcctcgctggcaacaaagcattgtttgcagttctgaacccacccaaccaccagaaattcaatgccctccagcatgctgcttctcaaactatcaggggtaaaggattagttctgtctgttttgtggttttttttttttttttttttttttttttttgcctttaaaaattttgaatccattacaggattacagggcaagatttttataaagttaaaaaagttagcagaaaaatgaagttttaaaaaagacatctaaaacccaagtcctaaaatattgtcaaactactagaaaagcttctaaatgcttactcttaatttctgtctttatcttgtctatggaccataatttgagtggcactgctataaaatatcagctagcaaaggacagaaaacgggtactcaatttaagatagtataagtggcaatgacctggctgtcagaagattggaagcacaactgacagaacatgtgatctaggacaagtcaccggcctttccaggcctcaaatgcaatcatttgcaagacagggaaatagggctcctcagtaacttttttcaacatagttttttcacatgactttcttcaaacacaatcttaaacagaaggccaatctgtacaacatctcaggaagctttggctgcagcggggtgggggcaacccaaagctcatgtcccaaccctcccctcaaatccccttgtaaaagcccctggggatgctagaactctatggaatccactttgaaaatcaacagctacatttttaaggtccatcacaattctagcattcattatagcctagataagtccatagcactcagtaaaaggagaaggcaaaagctttcgagaataaaattggtcttgggctgggggcgctggctcacacctgtaaacccagcactttgggaggccgaggcaggtggatcacctaagatcaggagttcgagaccagcctggccaacatggcaaaaccgcatctctactaaaaatacaaaaattagccgggtgtggtggtgcagcctgtaatcccagctacttgggaggctgagacaggagaatctcctgaacctgagaagcggaggttgcagtgagccgaagtcgtgccactgcactccggcctgggtaacagagtgagactccgctcaataaataaataaataaataaataaacaaacaaacaaacaaacaaataaaaattggtctttaacattatataatatatataattcttaacactgtcattaacctttggaatgtcagcaattggctgtcagaattgtacagccaaccaatttcttccaaaaatggtaacacagaatcaaaactgaactcccgcctcaagctgctaactgggtcctcttgaggctcacaacggctgatgatgacctcaggctgcccactcttccagctctgcgtcgtaaggtcaggaagggaccacgaggaaggggaagcaagggatgggatggtgctgcccagacctgtcaccagagtcgccaccctgctcccttcagactacggctggagacgctggagacgcagagctttgccttctccgccaacccttcccccacactgcaacccaaagaaaggtcccccttcttcctgttttcatgatgtcacagaaggaaaatctggggaggaatgttatttctgctttcctggcaagagagaaggacagaaggaaaaataagccagtgttttcctcctcttctcctgcactagaccatatgtatgtcagtttcttactatcacaaaagctcttaaaaccacttgcttcatctgtcaacaaacaaaaagccaaatctaatcctttcaggccgaacgtgtcctggtgaagctctaaccaaacaaaacagcccagcaacttccaacccttgggtgtgttggcaggccctgccctcaccctcactgctttctcatttcttctttatgagtgtcttattatgaagttatgtttgctgatctacaagacgacataaatttttactggtactaaaacaactctcaaaaagtcaggacccactttctcctttctggctcctctagaaagcagaggcaggcccaagccccgtttgaagtccttgctgccgggagatggccagtttatgtctcttgtcctaggacaggaaaaggatgcactctcggcaccatgtgctagagcgagataagaccagagattctgtcctcggcaccttatcagcttttcctgccactttccagagcagacagcaccatggctggcaatgaacgaagctagttgaaggggggttgggtgtgcgagtggcttggggactgcagggagtgaggtaggcagggtgtagaatgagaaaaggaaagagaagaggttcttcgtgtatcttaaaatggtttggtccccccaaaattgccttttttttaaaaaacacatggattttgcatctctgttggaactggagcaactaggagagatgtttttataaggacttccgttctggttagaatgaaccaccactttcattgcttcgcactctgcccgtcactgccttgtgcgactggctcctgggcacgtagcacaggatggatctgctatcagatactccgtggaaagactgcggggtccaggttgcagagcgggtgccttccacaggcacgcaagcctctatctgcacacccagcaatctcctggggccaggacacacttgctcacacgggataatccgcctcacagtgcaaaggaacaagggaggctatgggacactcctccaaatacagacgaatggcatcgatgagctgctttgttctccaacaaataacatctgtgaatccaaggattacactctttagaaaccctggtctttgggggctgggttagggagggggtgaatataactcttggaaaaaaacctagactaagcagggaaattttaacttagttatggactcagttattgataatgaactcatgaaagttcaggttgagtatcccttatttgaaatgcttaggaccagaagagtttccgatttttgatttagggatattcaacctggaatatcaatataaatatgctaaattgatattccaggttgaacatccctctcgtttttgcaaattgttgtcgatgaaaccaaatcatttgtcctgtaaagttctctcataatcagatttttgctgaatgtatccccgtggcataggttaacacatttctctgtctcatgtatctcctgtagggttcaagtgagaggcagccttactttctaacggagcacttttccaatgccagcatgttgttttatgaaaaactgggctggattcatggtctaagtaagtttgggaaacaaacctgtgctattcctccctttgattcacaatgcatatcaccatctgagacacgtggccgctgttaaacttcagaatggcccacatttatttgatcctggaaccctttttggtaaacacccactggcatcccatgaaattagtgctctgctgaacttactttgaaagggctatttaaacagatagttccattatctggataaaatgagtagttctcttgttaaatctcatagttaaatctttgttttgtcccagattgtccaagagggtgggcttttacccatgtaagtttttgcaaaaatgacaaaagcatagcagggaagtgaaaagagggcctggcaagcatcccactatggacgctagcttgcagagcgcctctgggaggagaggttagctctttcccagctatcacatgattgaaatgggaatgtctgttcctaggtttagaaaaattacgcttccattttggaatggagggtagcggagaaataacatatcctaaatgatgccaagtatggatgtattttctttgtttacttttaagactgcctacaatctagccgtattttttaaaggattatgtgtaagcagcaagccctgcagagtctgacagtgagatgaccactgtgaagaaagatcctgggcgtcaggttccacttaaaggccgtgcaaagttcaaaccacagaaccaagaataaatgtataaaataacgaagtgaataaaatatggaacacagaagtcaatggacatataacaaaatcaaattcaaaaaagcaatttctaaaagtgaaatgaaacaaacttgattctgcaactagctggtgaagagccacacaaaaagaaattccagatgactgaaaacataataatttaactgtatagactgaatgggaaatacataaagacaaaaagaactgccacacacccaaaacaaaccctctgaatctctctctctctttttttaaaatgatcaagttattggcattactctgtaactattgtgtgtataatgggaaataagcaaatgagtactgtgatattttaatgcttttatttctggaacctgttgattccaggaaacttactgtcgggaagtaaagataaaagatgagtggggttaagtacttgtggtcctaaatctaatctggcaatatgactataaactcaggatatattttatcataaagaaattatagttttatacatgtaacaaggcctacaaatgaagaccaatctaggaagaaatgaacaaccccaacgcctagactgtgtcgctaaatatcacttaccacaaagaaaggaatcagggagaaagggacgactccaagtgtggggcagaaaatgtacacagtggacctggaaactcttacactagattggaaggaagctattaaataccacttagggtcatctcaacagtactcaggtcattatctgtgtatagagataccagagatttttgtatgttgatcatgtatcctgcaactttactgcattcatttagttctaacagttttctggtagtctttggggttttctacatataggatcaggtcatctgcaaacgagataattttaatttttcctttccaattcagagatcttttatttctttttctcatctgactgctcttaatagtacttccagtactatgttgaacagaaatggcaagaatggacatccctgtcttgtaccagatcttagagggaaagctttcacacttccccccatcagttatgacactaactatgggtttttcataagtggcctttattttgttgagaaattttctttctgtacctaaattgttgagagtttttaccaataaaggatgctgaatgctttttctgtgttgactgagatgatcacgtggttttgtctttccatctgttaatataatgcattacattgactgacttacacagttaaaccagccttgcacgccaaggataaatcccaaacaaatgaaaacctagctgaaaaagaaaccaagaaaacaatcccatttatggtaccatcaaaaaaaaaaaatcaaaatacttagggataaatttaacataggaggtaaaagacctgtacactgaaaactataaaacactgatgaacgaaaaaggacacagatagatggaaagatattccatgcttatgaattaaaagaatattattaaaatgtccacatgacccaaagcaatatacagattcaatgtaatctgccaaaatcccaacggcattcttaatagaaatagaaaaaacaattctaaaatccacatggaaccacaaaagacctcgaataactgaagtaattctgagagagaaaaacaaagctggagacaccacacttcttgatgtaaaattatattacaagctatagtaattaaaacagtatggtactggcacaaaaaacagacacacagaccaatggaacaggttagagaactgaaataaatctaaacatttatagtcaactaatttttgacaagagcatgaagaagacacaatggggaaaggatagtctctttaataaatggtgctggaaaaactgggtttctcatgtaaaaaaatgaaattggaccttatcttacaacatatacaaaaatcaactcaaaatggattaaagacctaaacataagacctaaaaccattaaactcccagaagaaaacacaggagaaaagttccttgacactgcttttggcaataatgtggatatcacaccaaaagctcaggctaccaaagcaaaaatatgtaaacaggactacatcaaactaaaaagcttctgcacagcagaggaaacaatcaacacaatgaaaaggcaacctacaaattagggaaaaatacttgtagaccatgtatctgatataaagttaatatctgaaacttaaaaagaactcaagcaactcagtagcaagaaaatacataacctgattaaaaaatgggcaaagatgctggacaggtatttctcaaaagatgacatacacatgaccaaaagatgctcaacatcactaaccatcaaggaaatgtaaatcagaaccatcatgagatatcatcccacacccattaggagagttattatcaaaaagataagagataataagtgttggcaagagtgtggagaaacaggaaccctgtacactgctgatgggaatgcagattggcataccctcaaagaaaaacagtgtggaggttcccaaaggaattaaaaatacaattactgtatagcccagcaacccctcttctggaaatatacccaaagcaaatcaaatcaccttgtgaagatgcctgcagtcccatgttcaccgcagcagtttgcataatagccaagacatggaaacatcctaagtgtctgtccacaggtgaatggataaagaaactgtggtgtgtatgtatgtatacagtggaatattactcagcctttaaaaaggaggagatccagccatttgccacgacatggatgaacctagatgacactatggtaagtgaaataaaccagacaggaaagaaaaacattgcatgatctcactgataagatggaatagaaatagagagtaagataaaatgtggttactggagcagggtgggggatagaaatggggagatgtaggtcaaaggatgcaaagtagcaggtgtgtaggtccccacactgtaccttagctctctgcacttcagatctaaggtatggtgtggggactgtggctaataacagtgtactgtgtcaggaggttcactaaatgagattacacctgctcttgccatgaagggaaaatgggtaactatgtcactacatatatgtaactcataacatgtacagctttaaatatactcgataaaaaaaaaaatttttttttttaagtactcagaggccaggcgcagtggctcacgcctgtaatcctagcactttgggaggccaaggcaggcggatcatctgaggtcgggagttcaagaccaacgtggccaatatgctgaaaccccgtctctactaaaaatacaaaaattagctgggcgtggtggctcacgcctgtaatcccagccactcaggaggctgaggcagcaggatcacttgaatccaggaggcggaggttgcagtgagccgagatggtgccactacccttcaacctgggcaacaaagtgagatctgtccagataaaaaaaagtactcaggagccagactcccactgggtagaaatggaaaatttgatcaccaataaagataatagctgcaatgcattgaaacgtcaaacatttcaattcacgaacaataaaaaaaggaaaaccctccagtcatctttggagaatgctagagcacctcctcatttggaaattgctaaataaaggatataaatatttattctgtctttcctatatgcactgttcctcagagtaatctactaataaggggaaacacacattccaaatttcattctaaaaatgaaagaggaacagaaagaaatatggagggagactccatagattgcaagaaatttaaaagatatatcaaccaattgttacgtgtgacccttatttgaatcttaattccatgaaaatgtaaagaaaactgaaatttatgacatttatgaacattgagctttgaacacttattaatagtatgcaattactataaatttttatagagtataatggcactggagttatacattttaaaaaagaacctcttaacctttagagataaatactcaagtactaaaatacctgtggatgaaatagtgatttctgggatggatttgtttcaaagtaacacagaaaggagaagtgtctggagcacttacagactagccatcagtgtgtttgttgttccccaaaaggacctgtgctttcaagaacccgtgtctttgcagatatggtctttttttctctctggaaagcctctgaacctgccagttgctgctccttcaagacacatacaaaggttatcttccttgatctctgcaagctgaatccagcgctgcatcacatatgcccccagtcctctggcacagcactcaaggcctttgctccagttgactgtgaatgtcccagacttcctgatgaggttgtgaacagggattataccttacccatttaatcatctgtcatgcaataatgctactgggtagcaagaaaaacatctgagttaagtaggaaaaggaattggaggggagagggaaacaggaagaaaatgattaaagtactattactcagaactatgaaataatgagatattaccctgaagggagtcattctaagactatagccttgtgtaaagacactgagtcaattcaagcctgatcctaacattttaagacacagatgactagaaagtaggctctgtttatgaatcacttgtaacttcaactcaaagacagctgattttattcactaatgttaagaaggtgcctccacagtatgagcctaacagtggttaaagccttgtaagaatccctataaagagtctaaactaaactctgaccaatgatgataatgtgtcatgcatcatgattaatccaatttagagtatctgaggtccattaaaaaacaaaataatgtgaaagtcatgcttctgcctgtataataacacacagatctccatagcagggaggacacaggggatgagagtgaggaggctgatctaaaacgaaatgactgatttaactaaatgaataatatcactgttttactttagaaagcacatcacacattttagaagacttataagtggctctccttaggatcacaaagtaagcaggcacacaaatccaatctaaaacttttaacaatttgggaatcggaattcgatacattattttaaagctgatactctacttacaagtttcagcgctacctagaaataaaagaaaactaactgcactgattcccaaagtctactcaacaatttcctataaaagctatgttccttttagaaagggtgctgacatgaaatgttcagatttacttaggcaaagtagctttcctaagttagcttttctgcttgcagaaaaataaacctcacaaaacctagtttactgaaaggcataaagtaagtttaagcacttgttaaaaagctatttggagttcaggcccacaaaatgcttcaaaaccagtcaggtaaaatttaaaacctccatgtgattttaagagtcagaacgtgaattaaaggagcctggactaaagttaggggacagaggtgactgaaggggggatgtcattaatgctagtactttgcttaaagcaagcctttttgatgcagaaaagataaacttgtcaaagaacaacagatgacaaatcaaagactaaagcatttcagcctcgtgctctttggcagagactgcccgctgttcgaagacatgcaaactctgagtgaacttcctagaggctcaggtggcttcagaaaagaattaacagaaccttcagaaacagaaaaacctaccagcactctgatccctaataaacataaagagcgtatcatttaaatcttaccaaggaaaaaaacttctttttagaaaattcccataacgttttaagctagttcaagattgtgttttaaacagaaatttctggttgttacaaagtagttccaatggaattatataagattacaatttaaagacagataagcatcaagagatattctaaactacacttacagctattaaggaaatcctactaacttcaagctaagtttaagctgcttcttgcattattctatggaaggattggcgtagcaagttaacccatcagaatcttattttaatactttactttagaaccagtctacgaaaagataagattcttagactccatccaatcatgcttcggtgataaattatccaaatgacttaattataaacagtttgaattacaaagaactcctaaggcacaggaaaatgtttatttaaattactataaaaaacactttcaggtagcttcaagcaataggatagcactcacttatacaaacatttgttgtactaattacaattagttcttattatagcaatcccactgggacagtttgaacaataagctggggttgaagctgttttttcctctagaacaaaagttctcaaaccccaaactcaaataagaaagatcttaaatacaaatgcttttcacaacactgaactaacttgtgtggaaagaccgatttttaagtacccagtatgtggaggtctgttgcttgtgtatgtataccaacatatacgtgtgtacaggaccccactccatgtaaggaacaaacactacatactctaatggaacacaaatagtgtactgagaatagttcttttctctttagctagacaagtgtttaggtttgttaccctgaaaatcaaattaaagatggaaggattagctacctgaaaagattctggactgcgtatatcactaccagattaagggagtttatgtggcgagcgcagagctagaccacggtgagtaaaagggaggcagtcactttcctcactgaggacatccaggttgtatgtggatccactagtgcctttggtttataatccttcatttttcacattttcatcgattcaaaatgccttgttatcttaaaaaattattcttaatcatttgttcacttccttgccaatatatttaaagagacgttacattttaggtgaatttcttgggactgacaaacctgataattgaacatcagagttaggtctataaacggcatcaataccttcctgaagccaatacaaaagtgaagaggccttcctattctcttgcatggttggctctttctacaacaccaagtagcgtggctgtcttggtaaacaggggaatggtgccagtaaaagtggggagttgcacggttcaaacgtgacatttcctaagcaaggggagccaagacagtgtgagcagaactataaccctgagaaagaaagaaaaagtcccaagtctcagcgtggctgcagcataggcaggacccctccagcctactttaggaaaattaagcgtgagctacgccccagaagggctcaccccacagggttggaccctgtgactggtcaatgcaggggcacaaagactctgccccctccaaagatctggggcagttgggaagagctccctgtggagtcagctgaaaacttcagtgtatactgcaggccaaatcctctccctgtgtaatcttgcttcctccctcttgctcccccagaaagcagtcctgaaagcactcctaggaactttctgcaggccaactcccaggaaccaacctgcaaactgcacttgcacccagcgcctctccccagacagccctcagctagtggcagattgcaccccactgtggacccctaatggggagcatgtctattcgactgtctttgaacatttttaagactcccaagtagccccccgatctcagtgaattatctcatgagggaacaattactgtgtgtgtggaggggtaggcaacaagtattctggttgtaaaacgacatacattttaacagtttgactcttacccaatttttcccatgagctctgttatttttatatttttgtaaaatatttttcatgaatgcataaatagcagaaatgtctatatttgatatattatatatataaatgtatttacatatatatacacacatacacatattttatgcacacacacacacacgtttgtttgttttttttccaagagacagagtcttgctttatcaccaggctggagagcagtggcgcaaacacagctcactgtagcctcgaattcctgggctcaagcaatcctcccaccacagccccccaaggagctgggactataagtgcatggaccaccacactcagctaatttttaaattttttgtagaaatgggatcttgctaggttgcccgggctggtctccaactcctgggctcaagcaatcccgcttcagcctcccaaagtgctgggattacaggcgtgagctaccatgcttggctgacatatcttctatttgacattagtattttgaaagagtttacaatattattatctttcagattacactgtaagctatgtgatggcaagaaccatttaccttttggtaaaaagccacacaagggaaattaaggataaatgtggattcagcagggatggtaatctatgtggttaaagtgagtcagtgtacggtctctttacgaagtgaatacattaaagcccactgggaaggtgaaatcaacaaaattcaggacatgggaaattctgtaagacaaggaatccaaggtgacttcaacaataaactgcaaagaaaaaagagagaaggaatgagaacctattggttaagaaagtctgaaagacattatcaattaatctataatatacagaccttgttagattcaaatacatattcaaagtaaaaagttattagacaactggggaaacttgaacattgactggatttgatgatactgagaaactgtggttaatgttttttggtgtgataacagtactgtgactgtgtgttatggagtccttatcttttagatatataatacatacagataggatgatgtgatgtgtaggaattgcttcagtaatgggaaagaggggtgggagtacagctggaatgaggctggccacgaattgatcattgttaagctgggtactgggcacagacagactcctttattattctctctacttttatacacatgtaaagttctccataagcaacagttttaaaaagtgaatgtaggctagacacagtggctcacatctgtaatcccagcactctgggaggccaaggcaggcagatcacatgaggccaggagttggagaccagcagttgaagacatggtgaaactttgtctctattaaaaatacaaaaaaatcagctgggcatggtggcatgtgcctgcaatcccagctgctcaggaggctgaggcaagagaatcgcttgaaaccgggaggtggagggtgcagtgagccaagatcgtgccactgcactctaccttggaagacagagcaagacactgtctcaaaaaaaaaacaggaaaaaaaagtgaatgtatatctattggtataatatcattagagttcttcctggagtacagtaagtaacctaaggcatctgtgtctaagtgaaagtggtcacagaaagtggcctacctgaagcctggcagttccattatcctaggagaaatcatcgtggactcttgcagaaaaacaaggctgagaggaagccaaccaaggcagaaaggtgaccccatctgtgcgctgactcagacagcaaagcggtgggtttcccttatgagatcatggattggccgccagagaccgctactaatgttagaacagggtttttccctgaaagagtcacaattcctctccctggcaaaacaggaactggtcctaacaggaatattatgtaataccagaactgaggagctcaggaaaagcaggatgagggtgggggtggggattgaagagcagagccctttgtgggagcgtgaaagggacaagcccagtaccggcttcctgccagcctccccttccctcctgctgcagcgccttccctcacgggatgagcaggcatctcataggcagacagaacatggagcaggaataaaagactcccaccttctccaaggctgacggtaactgaccatgtaactacagtgtaactgaggggaccctgcatagacagaagatgggccagcgagatgaggagccatgctggacgagcatcctttttttccagatgtaataaggtataagtgacagaggaagactctatgtttaaggtgtgccatgtgatgttttgacctacatatacatagcaaaatgatccccacagtcaagctaattaacacatgcatcacttctcacagttacctttgggagtgatgaggacacctaagatctaatctattagcaaatttcgagtacacagtgtgttcttattaactgtggtcaacatactgtatgctaggtctccagaacttactcatcttagcctctgtccagaggggagctcccttgcaatgtagacagggcagtggtcagaggagtagcattttaggaatgtcctcaaatagcacagggaccataaacaacacatgtcacaggcccagtggcagagccaaaaacgcaagctgctaaagagacaaaacgtgttcaattgtttttcaagttcagtattgtccgtatccgatgaccctgcttttgagacagacaggaagggtacacaccactgagaccacacacacacacctccacgtgcccagcttttcactgtggttatctctggctgtttggatcatggatttttcccccttcttcctaatgtactatgtacaggtcatggtttctctagagtggacaggtactgcttttataatttaaaaatatttgaaattaaaaactcacaccgaaaaaaccctacaagcctagggcagagtgctctctctgtgaggacaactgcattcaggaggccaggatgctgtcacagccaagcggcaggtcctgaccctcatctcgacaagacacaggtggaggcgccgtctgcactcactctcaggactcaggttccctcctcatccctttcccttccagaaggtccccatgcttctctcaaggttcctccccaactacaccccaccggcttgtgtctgtaagcgatctaacggggctgaataaaaaagtcttccagcacagcaaatgacagaaaaagtgttcaaatgagaacaaaagaggcttttcaggaagtcacaactcgatggcagagaaggctctgacatgcactgatgagtacatgaaagaagtgaaggacctcacagcatcaggtcagatgtggaggaaaagttaacagcacgagcgatgagatgacaggcaagccagggggaggaagcaagggtgagccagcagaggcttcacatccagagctgctcccatctgcacgtctgccctgccgtgcgctcctctcccaggagccgtgtcaccatccatccaagctgtcggagcctcaactggtccatactgtcagcccccaatcccagggcctcgacctcccaacatgactccaccaagctgcccctttctctttgggtcttgccaccactgagcagctcaggctgaggctcaggctcgggctctggcatcctctggaacagcgacctctacctgcctgcctcagtctggcccctccttgccctcttcattcttagtgctttatctctgctgctaaagggatctttctaaaatgcaaaagcaaccagccccgtcccatacttcaaagccccagaagctctcaagtacacgcaaaacaaacagtctatactccctgcagatgtctaatgggggctctcagggaaaaaaaaatccccctccctcccccagtttttattgagacagagtatcccaccgttgcctcggctggagtacaaaggcgcaatcttggctcactgcagcctccgcttcccaagttcatgtgattctcctgcctcagcctcccgagtaactgggattacaagtgcgcaccaccacacctggctaattttttgtatttttagtagagatggggtttcactatgttggccagtctggtcttgaattcctgacctcgtgatctgcctgcctcagccttccaaagtgctgggatgacaggcatgagccatcatgcccagccaaaatcccccctttttagatcctcagcttatttttcaacacccaccagaaaagtcaaaattaattcataacaagactctgtttttcaacatccagctgcagctaaagcatctgaagcctctagtgactcccgtccctcctcggtggaagcacacatcgcaaatgctcagtacacagcatccttgggtcactgcaggcacagtatgaagtgaccagcttagggatggcagctgctccaggctcctggccgtgacgagggctgaggggatcaacccctcggaccaccaacaatccacttgtggcatgccagctggtaaactccaactgagaataaaggggactgttgaaacctgcttgtgaagctacaattagaatttaggcttcagtgcaaagttggaaacatagctatattcttttaaaaggactggtgggttattttggtttggggagctccagcccccatctttgtggcggctgctgatgtgcttgggcgatctgctggccccctggctttctagagagagtctgactacaaactataaaccctggaagagacgccagggtggtggcggcaacctctctccagcactgcgcgaggcaaaggacttgcatttggcctgtggtgctgccgcggttcctgcctgggagcggggagacatcctgccctcttccaggttgacaagaagcgtgcagcttttgaaggccctgagacccccaggacaacatgccccatctcagtctctccacagaggtgccagttacacctggcagtgatgagactcttaactctccgtgctggccaggaccgccccctctctcccgctcaggaccagcaagggtagcgctggagcttgtctgtattacgatcagctattggagtctgagtctctggataaaggtccagctatttagagacctagagaattatcctctcattggatgacagcaggccccgcagatgcgctggcctcgctctccctgcactctccgcgctggatgggcctgcagctgcaggttcctctctgccctctttccacttcacgtccgcacccactgctacttctgcttgaaaatcctcctgcatcttctcttactgacccttttgtcctttatggactagcaaggacaacacctcctccaggagggcaggaacccacctgagagggagatgccccgggggccacgtgcacaccttgcctccagctcaacagttaaccaaaccgcatcaaaatcattgaccgtccctcccccgtgacgctgtgcgctccctgaagggacagactgtgcctcttcttcacagtccatggttaagagcgcctggcacccgccatcactcaggagtggttctgggagaaacagatgaagtaaagcagtttacaacaaacagaaatactctcaggaatggaattcatgaaaggcttgcagatggtacaccacatacacgccgccggtactctggcaaaggtatttttagcatcttgagattaaatggttgtatctataggtgactgtaataggaaaaaaagaactacttcagggacacgattaattgctgtgatgtgataaacagcagtctacattgtattcctcatggcatagctgtcacctgtgtgaattacttagctcataatgtttactatgttagttagtgtgagtatacacaatacaccatctcattatctgagatgcccccttacctctcccagtcaagcagctttcatttccaggtggaagctgaccgcacactgcacctcagcccttgtccagactgtcttgttgccacttccatggatttgctagatcctgctccaaatgaacgtgtttcccggcgtgccattctgaccctcgctaacatctactgagtgcctactatgcgcgaacactctgctaggggtagatacacatgatgacgaaagcatgatcttccgcttgaggtgcttcaagaagtgtaagcttgaagagctcctgcccccaagtctgtaactcctagtgtctgcatcctctaaactattttaacaagcatattatctacataatgctcaattaactggtctacaaaccaaattattattgacaagttcttctgagccaagagttatgctcctgagcttagtttgcccaaatgttttcacctagaccaggggtgtccaatcttttggcttcccagggccacgctggaagaagaagaattgtcttgggccatccataaaatgcactaacactaatgacagctgatgtgctatttaaaaaaaattgcaaaaatatctcacaacatttaaaagactttacgaatttgtgttgggccacattcaaagccgccctgggcagcatgcagcccacccgccatgggctggacaagcttgacctagaccattacctttctaccaaaaagcttctaaggaattaatgctaaagaaaggacacagacgtccgctggaacgggggcatttgttttaattttaattattaaaggtcattaatttcaatagccagaaaaaaaaaaagaccttacttgaaaaacaaaagtatagtgaatttacaaaccattttgcctcagggatctctgtcaaagcagcaacatgaatacacttaatgctgttgtaacaaatcatgacaacatgagtcactgaggagcctcttagtatattccttatgacctgtacagatttaactcaagataaacttcaaacaaatattgcaatgagtatctagtaacagattcaaagaggcgacaaaataattccactggggtgtgtaaaagctacgctgctcaacatagcatttgtgtgagaagataactacattcaaagatcaggaatgtttttaaatttgaacaaatgtaaactgttttaaaaaatggacttgctagttgctaagcaggtgtcgtcaccagaataactctcttcattaatttttctcttcaaaagtgagaacgttatgaagtggcagtgaaggggtatttttagaaatgggctcagatgaaccaaaatattaatgctcaatcactggtaatctatcacgattaaaattttaaattacaattttttaaaaataaaattttaaattacatttaaaacatacagatcttaaaatttcaaatatttccgttaacctacacagaaaagtaacttttgtttattcacaaaaagtagcttcatcatatattgacttaaaatatccgaacagtattacaaagtaaaaaggagcaaacccttcgcctgttgctaccttttttttttttgagacggagtttcgctcttcttgcccaggctggagtgcactagcgcaatctcagctcactgcaacacctccgccttctggtttcaagtgattctcctgccaagtagctgggattacaggcgcctgccaccacgtctggctaatttttgtatttttagtagagacggggtttcaccatgttgaccaggctgatctcgaactcctgaccttgtgatccgtccgatcacgaggcttcccaaagtgctgggattacgggcatgagccactgcgctcagctgctgttactacttttaaatgagtgggaagatgcgttcaaattagacttttacgggtttaaaactaaaatccgagtgcatgtatgtttttaagattccattttgtttttagtgacatcaatataacaagtgctctgaattcctcccaggaacagaaagaccatttatctactgtatttattcagggcaagcttcccatctgtgtcagactgagagatttaacattgctgaagaatgcaggtggtgataaaggagggtgacgctagaaatgaacacctcacgtttccaaatacttttaaaaaggacaaatattatactcatctagaaagtgggtatgcattcagagaatcagaagacaaaatccaaaagcttcttgactttataaatgcaaaattctaagattaattcattcaaaaaacaaatcacttggttgggtgaaaatcctaatatcgaagtaagaaaattcaccaaatctccagggctaaggattatcaaacctctgcctctgccaagttcagttcatagcaatgtctttgacctggctacaaacagagggcttggcttgctcccaggctgtctttcttagctgctctaatcaatgaagcagaaagggtcctttctaaagatgccagcaaaatttttaacaatcaacgtcaccttaagtaaaaattaaaagtctctctcccccacaccaagacggagtgttgctctgtcgcccaggctggagtgcggtggcgcgatctcggctcagtgcaatctccgcctcccggattcaagtgattctcctgcctcagcatcccaagtagctgggactacaggcacacactaccatgcctggctaatttttgtattcttagtaaagatggggtttcaccatgttggccaggctggtctcgaactcttgacctcgtgatccacctgcctcagcccaataaaagtctttaacttgtgactttatgacttatttttatagtcactgcttgtaagaaaaaatcccaagactctcaaagcatactgtattacctaaataggtaaagtcaaaagtaaagtgatctcactttttaaaccaaaatctctgttacggaatgccaagtattatgacagttagcaaaaaacaacaaaaaggccctattcacaaatcccatttgatttttttttttcatgatgcctaagcttctgtcccattcaactgaacaaagctttgtatggatgaataaaacagagccattgctttagttgcctaaaggtggtttaagacaaactattatcgtcacagaagaaaggtacaggtgtttcaaaaagcgaactggctgatgactttgcaggccaagtggtgaaagagcttagagatttggagaaccagtcagttcaaatgataacgggatgggagattctgaaaagcgcagataatgacttagaagagcacagagaatatctgctgagtgcatggaaggagcttgattggctcagataagagaggcttccaagggactgtgagcaaaacccaagaaacagggcagcttgggggaaaagaacttccatctgaagtcaaagactccaggcatgcgaaaggcacaggatccccggggggaaatggacaataaaagaggtgcgatttgtttaatttcaaccagagtagagacacccgcaagaatccgatgagttccatttctacctctcgtatccagcctttaccattaagactcactcagccatcagctcccccttccagagagcagcttgggaaagggaatgaagaactctctatgagaggaggactgagctggccaggcatgccttccgggctgctgttctctttgtttagttctattctgataatagatttcctttaaaagatacaatgtttaaaatatgggaagtcctagaaaacaaacttgctcactccagacaggtgataagaatccattactctgcccacattttttatctgcgattttttccccttagtaaccttgtgtagctttcctcaacttatactaagagctgttaaaaaaaaaaagggttccagtcaaaaaagtaacattaagttttagagatgaaccatgttcattaccatataaaaggctctaagaaggatgcaatgaaaaaaattgttaaatatctacatgtttaatctgtgtttcccaaatgtatctgagcatgtgacaatgacaactatcagcactcccctcctcccaacccaaacatctaccagcaacactgatggttccaaggaacacattttgggaaactctgccctacagcaatgctgacagtaagaaccaagcagaagaaacagccccacagcttgaatggaagctgatccactctctgtctcccctacccagtaacacacgtgaacctccagtacagtaaagcgggtgacggagagtgttgctgccgtggagggagaagggcctggtttttcagcaggggtcttcacgctcactagtctgagtcttcagccaggttactttaacctttgtcagcttcctcatgagtagttcctacctctcagggttggtgtttcagggacctagaaggaaacagtgtttcaaccgcactctaaaaaccaaaagctccctcaaatacaaggcattactgttgttagtaagccactgactgtgtgacagaaagggtgtgctggaagacacttctactgcacttagctcaagcctgctagcagagcctcaaacagtcaacagtggcctctcctgatctcaaagttttgaacacatggttataggagacaatattgttgtttaaaacaaaaaaacagaaacaactttctaaaaacaaacagggcctaagtcatgtagattactgcagcttcaggaatatatgtaagccactattttattcaaaataaaaagaggacccctgaatcagattcagaagaaacctaagcattgaggaccaccaggggtgcctgaaattcactttatttctagcacttcatcatcacagcaaaagatgcctcaaaccaccttttcataccttcatataatttgaagagaaagaaaacagcttattttcagtcacagagatgtattaactcataattcaaaataatttattcaaaaatttgaattaggaaatggtacagcaggaactagtgacctctccactgtctgatggagagaagaaatctacactaacacaaccatgtcaggagaatctcagccatctaccaatgcatgcaggtgggacattctaaatgatgagctaaacagtccttactacttcactctatcagaaataaagcaagtattcttaaagaaaataatgaagtactgaactgacttttcaggagtaacagctacactagaagtgaggaatagacggggagacagattccatcctggaactgccccatccacacacatgtttctgggatgtttgtaggacacgggtaggctgcctttgaataaactgctcagccaacatttttgaaaacttaactgcatttcttttagagtccatgtggcctgggtaatgcttattaaatgcccactgaagtgtgcgtgtatgcatactcacatgtgtgctgctgaaataatgagagcagcacaggctccagccttgagaaattattacttcaagttgacttccaggccctcccaaatccatttccctcaaacgtaattggaaacaaatcagaatgagactgtggcaacatattatttttaccagtttttaactagcacatgatttcagaagtcaatatgaagttacacttccacttgatatatataaaagaaaatataacagtggaaattactaaagaagagaaaaataacttctttttatcagtcaaacatgtagccaggactcctggggaaaaaaagccaaccaggcaattcaaaagctgcaccgatggccgtttaggaaagtctcttggcagtaagccaggtaaaactaaactctttccatctcctcctcaattacttttgcaactctctcaaaaggtagagacaccttttctaaattcagaaaaggtgaattattttcagtctaatggcctggtcactgtttctgaaattacataccatattacctgggagcttgttaagaatgctgatttctagtgtcgagccagagcctacaatatgcatttctaataagtccaccgggtgattctgccagcttagaactggaggcggtgaatcaattactgcttagtagctcctcctggtgttagtttttcagaaaataatcagttttcccaaattgtgcacaagcagcaatgatttgatattagaaaaatgagtttgtactcacgtacactttcacagcaaggaaattagaggtaagaacccttcctactttcttgggaaactgatcatctgtattataatatttaaattttatttcaataaaacacagtatttaaaaaaaggttttctagtttgtcaattttttttttcagtgtatttggaatctatatctggacagagtacctgcaaaaagtaacagattcacttaaataattttattataaacataaacttatgttttatgctgttaactatatttgaatacaatcatcaatttaagatggtctcaacagaactgttgagactttaaagggtgtgttcatgcttcacgtgtttgctgttgcttttacaagcgaacagttctccttgaggccccgaggcctgacagttgctggggaaatgatgggacagacgtgtctgctcctgtttccatccttcttctgcctggctctgccatttctcttactctgcattctagacctgccaccaaagattccagttcattccccaacacacctgcttggcttatggaggtccaacttcaatacgctttgaaatggacaggtgagcggcctgactgggagaaagcattcgggcaaaagtggagccactcagaccacattggtgaccactccacagcagtctaatcccacttactgtccctctctaaactggggtgcagtagacagaaccacaatccctgcatgtctgagtgacgggacatgacacagggccattaggtaagaggagccgctggcaggggatcaagggaggacaatgtccaaggactacagactagaacatggatgctgggaattttactgggcaaagtaggttttttccaagttagggccacttccaacaaagctgaatagggaacatgttctcaaccacggtctgagttagtccttactgggctatttgtcattccactagctgactgctaaggctcagaaaggttaaattcctgccaaaggtcatatgactcacaagggcagagccgagactgcgatccaggtctgcgtgatgacacatcccggactctttctactacaccacaccattcttgcatctgttactgctagtctttaggattgttttccttctcagttttgatggaaataacattttttctatctccactgtcacttccacaaagtgagaccttgggtgcaggaatattacctaacaagagtctgatgtacagcatttggtattattcttaaggattcatgaacaagaacactgcgtatgtataaatgaacttgtccgacttaagagtcaacctgttgctaaacgacactgatgcaatcagatgttaccgcagagttttaaataatgtcaatgataattattttgcgattcttttactgaaagagctgttataagtaacttgggttcttcttggtcatgatcattctaaaacaatagaatggagtttatttacatgatctgactgagaataaactttttttttttttttttgagagcaagtctcactctgttgcccaggctggagtgcagtggcgtgatctcagctcactgcagcctccgccttctgggttcaagcaattctcctacctcagcctcctgaatagctgggattacaggtgcacaccaccacacccagttaatgtttgcatttttagtagagatggggtttcaccacattggccaggctggtcttgaactcctgacctcaagtgatctgcctgcctccgcctcccaaagtgctgggattaccggcctaagtcactacgcccggccaagaataaagtaaaatttcttaatgttacactagccccaaatgaaaaaggacagcactctcttctctttgctttcccacctcagaccataccacttgatccaggcgctcagcttacaggacccaaatactgaagcatgcagatgacaaatctgtcccaactctcctttctgcaagatggacactgagtcagtgtgagatggcggcccctgggggagtccctggcatcagtctcttcagctttctctattttcttaatagatggataatggagtagaagctctatattttatcatgatctcagcaagataaagaggaatatattttaggaagacactgctggtagaaaaccgaattccagaacacaaaaacctcagtgaactcttcttcccagtaccacagattaatcacgcctatcctgcagaaagggaaggaagggggaagtgaatagaggaaagggatggatttccaatgatggcttacgaaagcgtgcttccaactcccctcccatatgctaaaggaggagaggatgatggtgccccagctatctgcttagacttacttcctccaagaaaatgatgactgcacatttgctttatgccttaaagagtctccaagtactttcaatccatacaatttcatcaactgctaaagtgagcataggctgtcatccacatttcccaagtgaggaggaagaagatcagagcaggtatggtgtggtcccctcgcctagaagcaaaaagctggaattctctctgcccagctctgaagtgggcaagcttaacctctataaacctcagtttccttttctggaagtccagggaagacctagatggtcttttccagctataaaatttccagtgtgatccaaagtcacactgagggctcagtgacagagctgggacttgagcctaagtttctgacttttaaagcaatcagaccttacagaactacagcaaaccacctctaatgaaaaagaatttgtggtatcattctaacctggctcctggatgctttaaacctgtgagcaatatctcaagaatccagactgccaggagaacagatttgcctaaaagataaaggaacctccatcgctgaccacgggtatcgtcctggccccatgagagagcttgtcacaggaagtgtcaaggaaaacatgaaatgcacaagcaccactggaatgcagcaatctcacagtactgccccatccccgcaatggagaagcagaagatgcaatgcatgccgtacaagtgccagctacatcctactgacaaactggaagatgtacaaagaagaaaaagcaaagggcccaaatgattcaaagaaatgaacaagttaaaaaggtagtttgggggacggaagagcaaagggaaaaaaaaactttagcataatcaagaacttccttggaataagtcgaaaagcctgcagcattcaatgccagggaactccctcccctggaacagagaattgctttagggggaagctcacaaggctgaccgcacctggggaacaattgccaaggagacaaacttctgtgacttacacacagcaggtcactcatacactgatacactcatgacattcccttggagcacttcaccccacagacaagaacaaggttgacgtgtatgaagacaacctgcactctggagacatcaatcaaatttggatatcccaggcctggaatagctttgtactccactccatcatcttatgatttaaaaattactttttgggcttgctcccattctgaaactcctatctctttgccagaatccagtatcaacaaaaacctattggttactctgcattcctaaatcttcctaactgcttgctactctcaaccttgatttccccactagccaggagtacacagagggcaggggcccggtggaaccaggcactctactgcttctacacctcacttcggtcccatgggatctgggcgaagatctctatgaagggaatgtaccagacctccagggtgggggatggggtgctctgctcagaggactggggaattatattccagtaaagaaccaagatatggattctcctgggacaactatctttcttctctttgtttgcttccagccctgacttctactaatattagtatacacagcaagaagacttattgaaaggatttaaggaagaaataaactaggacatatgagggcaaaaataaattggacactagcaacttcacacttgcaggatgaccatgacattgtgaacttcaatgtcacacaaaattaaaccattctgtggtgggactaaataaatattaaagaacatattattagtagattaaaaaaacttttttattgtgcaaaaaatttcaaatatacaaaaaaaattagtgaaccctaatattcctatcaacaattaacaaagtttgccacattgttacatcattgctttgttctttgctgaaatattttaaggtgaatcccagacatcaagtcatttcatcctgaatgctgcagtaaaaaccactaaaaagtacggaaatttccttacacaatcacagtgccattagcacatctaatcaaacagacaataatttcttggcatctaatgcgatctatcatcagtttcctcaccagctcatggacgtctttttatggttcaaatcagctcttaaataaagcctacactagcgcatgatacttgtatcttttagggtttttctagttaccacaccctattctttcccacaatcccatatttttttcattccactgacttattgtagaaattgggtcaattgtttcgagctctgtcccacattctggatttttgtttgtttccttctaagattgcatctctataacttatattttctgtgaatgaaaaatacttctagagatttgattagatttaggttcagctttttggcaggaagagttcagatttatactgcattatgtcaggagcacacaaggtctgcttgttctacttccgtggtactaaggctgaaccataaatagtaggttctttattagactgaaaaatactctttttctgttgaaaacagatttactatgaaagtgaattttgtataactcttagtatagtggataatgtgtctggattttagtaggaaggagaaacttaattctttcatagggctatcaattaagaagcaaggaaatcaacctgcaatgtaaaactacccttgattcccatgagtattaaagaagttcaaattagctatcattttaactataccaacgaactcatatagttacctagttacctagtgagcaactactaacgaccctgagccagggcctatgaaagtacaaagccatggcctctgtcatatgggcagaagaggaagacacacactgttgaaaggacagcatgccaggcagcagacagtaatcagcaaattcagaccaacgcagagcgcagtgagaggcaggatggagatgaggaaactttccatgaagatgtcactgcggtgttagccgccgggggcagtgactctcatcaccagagcctagaacagtacctagcacagaagaatttaataaaaacctgccaaataaaacaatgagccagaacgtgctcaggggcctgaaagaggcagcagcagagtgggtgacacagagctgggtgagaagagccccgggaggtccgtaccaggagccagcaagcatcggcatcagggaagcagattagcgtgagctgggcaagggtctggtgtgtgtgttaagggagctgcatctgtcatacgctgggcactgctgacatgggacagcagcattggagaagagccgattttgagaataagctctcaaaacgctctgaaaggatgccctgcaagtaggaaacactggggccggggaggctacttaggattacaatttaggggtcataatgattaggaatggtttcatcggaaggaatgaaaaagcaagatgaatgctggaggattaaaaatacaaaattagcaggccctggtaatgtcaaaagaaaaaaaaagaaatcacagatcacactcaagatccaacaactctagctaagtaagatatccaattattaaaaatgtgcttagtgcttgtactttgtcccccacaaccctgggtatgggtttaatctactcaacatcattctcatatgaagtgaccctgcctatactttaatcaaaaactcaagaaggacccccgagaagacttggtttgacgctacaaagggagttcacacctcggaatgaagtgaagactggtggcactcagctcattcctcttttctcttccacatcacaaatacagtttccactaatctttcccaataggacaattattattactaagaaaggcaaatgcaataggtgaggcctgtctctcctggcagaacacctcacattctttctgtgggaaaggaaaatggagccaggggcaagttacctgacctgctgcgacctcctgcagggcgtgcttggaggaaccatccagcacagacagcctgctggctacaggaggcacacgcaaaagacatccacgtcagggtaataacaaccagcatgtatttatggaggttcagagcactttctgcaacccaccccatgtttcagtaagataagttaggaatggcatatttccatgatacactttagacaaccagagtactcgaagattgatgcttaacttgcaggaagaagccatactagtgctgagtgggtggcagagcacaggaagaagccacactagtgctgagtgggtgacagagcacaggaaggggccacactagtgctgagggaggaggcagagcacaggaaggggccacactagtgctgagggggtgacagagcacaggaaggggccacactagcgctgagtgggtgacggagcacaggaaggggccacactagcgctgagtgggtgacggagcacaggaaggggccacactagtgctgagtgggtgacggagcacaggaaggggccacactagcgctgagtgggtgacggagcacaggaaggggccacactagtgctgagtgggtggcagagcacaggaagaagccacactagtgctgagggggtgacagagcacaggaaggggccacactagcgctgagtgggtgacggagcacaggaaggggccacactagtgctgagggggtgacagagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagtgggtgacggagcacaggaaggggccacactagtgctgagggggtgacggagcacaggaaggggccacactagtgctgagggggtgacggagcacaggaaggggccacactagtgctgagggggtgacggagcacaggaaggggccacactagtgctgagggaggaggcagagcaccatctccttcactgcacagtgggggctttctcaaccttcttcaggcttggatccaacaagctgcagtaggagctcatggacgcacgtgtgggggagaggtctccatgacaccacggccgtacttaaatacaactcataaggaagtaaatctgaggagcaaacagagtaagtttttgtgttttctgtttgtgttttaaaatgggaatgatgccaggtctaagatttgaaaaatgcaaccattcccacccccctcacatgtattgagaggaaacagtttataacattgtggaaatgatggatgagaaaagggtttgttacacttttgaattgaaagggttttctcttagtctttctccactcctttccttcaataacgatttgctgaataccctgagcctaatggcccaaccactttccagagtggggaacagcagccagtgtttcctctacaagagaaacatgtgagggaacagaaggtataacccctggaaaaactgacccccagaggctctgccggcaggccctaggatgcagcggagggcaggggaggcgctcctgacaggagggaggccagggcatgtaggaggacctccccactagtccaccagagcccacgtccatggccccagcgagagggcttctctagagaagccaagccccagtgacagaaagacccgccaactctgacatctgggggttccctaaggaaatggcaaactccccatctgagaaggctgcctctgcaaacagcttccaaatggctcttcattaattgactgttaaattacagcagacggcaaaggatcatcggactatgtgggggaaatcctccctcatgaagggagcaaaccaaaaccaaaagaaaagaggaactcagaggaccaagacaggaaaacaatctgcgaatgtgtgaaaaacacaatgcctccagaggccaaggaacatacggttgtatccgtgagacaagaacaggacattattaaaaaataacaatgagatagtaagacatagctcttgaaaattaaaaatatgacagcaaaacttaccttataataagaaggttggaaaataaaaatcaagaaaatcccccccccacccccccccccaccaaagtagaacaaagatacagtaaaattggagacaaaagaaaaatctgaggaggaattcaagatgtcagtgcttcaactactggcttcctgacaaaacagaggggaaaaaattatgaaacagctaatgttccagaactcatgaaaggatatgaatcttcatactgaaagttctaccaagtgcctggtgaataaaaacgcccaaccaactcattcccatagggttttagaatctgagcatgttaagattctaaaaccttctgaaaatgagataaacaggtctgtgctaaggactaaaataagaactgcaacaatggctatcagaagacactagagtaataccttcaaaatgctgaaggaaaatgattttcaactcagaattctatacccagaccatctgccacagtattaatagagattttcagacctgtgcccttttcagaaagctgtggaagatgagtgaggacacagaggagctaaaaggagcaaggctggggaaaagtccaggaggccagggaaatggccgagccagcacctagtcctgagggagccgggaggtggaaatcttaagagagaggtctcctgggagacagatccagctgacagatgatctgatgcagctgacacactgaaagttttatattaagaggctaccaaagagtctagagggaaaaaacaaaatcacacagatatacagaatgcttttgtttcccatcagaaaacaaccaaaaattgttacaggaaatgttattattgtacactatttggcttagcagggtacgatatttacatagcaataaaaatataaaccccaaataacaaattcactaatcattatacaatacaatcagtagtttgagtggtgtaaaggcccagatcttaatctaccaaaacagaagtccacattttaaaaattatgacatggaaaaatgtcaatgcaagttattattgtaaaatatgaaggtaaataccaaataactgaggaagaattgaaagtgctgtagggaggaggcttgtgaggtggagtggcaaggatgactacagaatgctctttctttaaaagctgtttggcggagcttaatttttttacatctaggtgcgtatattactttgattaaaaaataacaagcatttaacacataatcgctatctatgagtcattgttcaaatgcttaatgtgatctcatttaattctgacaacagtcctaatagatgatgttactattatccctgttttaagatacaaaaattaaagtacagagaggttacatagcgtgtccagtagcgcagtgctagcaactgatagagccaagattttaactcacgcaatgtggaccagaagctggagatcttaactcggaaggaagccaggaaaagataatttcatcttgggaaaaacaatctgattttcacctattggtaaacctagatagtcaaaaccaatcggcctatctgacatgaataagtaggaagcatttattttctcatatctaaactcctatatttttctatcaacaacacaaaaacacagcctaaaaagcaagagcagcagaaaaggaaaagttggaaaaaaaactgcagtcacacaaactgtagttaaaaaatgactaagtttccttgatatatgaatttgttggaaaaccatttatcaacagcctgtttctctctagcagagtccctcaagccgagagccatgtcattcccctttgactgattaattagccaatcagaggacatttttcattgtgaggtatgatggtttatttcagctaatgtttggtctctaatggcgacacattaaagccaactcggctattttagccctgtggagtgaccaaaaggaaagaacagaagataaatcaaaagagctcccttcagttccccttcagtccttaacaaaacccctaaggagcaagtggctggagggaagatcctctaccaataaagagaaagaacaaataaaagaaaggcacacatgtcttcaagcgaaagagtagccttcctgtttctgaagagcaataatttatctgttgatttacagaccactgacagaacaggccccaaaagtcaatatttagctcttcttccttttatcaaaagctgtgctcaatagaaaatatagctctgtaatgcttcttactcacagggctcattttccctgcactctgaattagaagaggctgtgagtaacccatctcaagcactattcacaccaaagtcactccagccagccaatatcccactgcactgtgggttctctaagcttcttacctgttcctatgctgtgagggcactgaaaacacaaagaagtgaagttcaagaggaggacagataggaacattcacacatccaggacaagaagcacatcttcaacatgtccactgacagcacactcatcaaagcggctctaaggagctcgtctttgctatgcaatcacacactttatcatcaccatcctcgttcatcattctaattttatgaatcttcgaagttgtgttagtctgtttttgtattgctataaagaaatacgtgaggctgggtaatttataaagtaaagaggtttgattttggctcacagttctgcaggttgcataggaggtgtgccgatggcatctgctcctggtgaggccttgggaagcttccaatcatggtggaaggagaagggagagccagcccatcacatggccagatggcaggaggaggtgccaggctcttaaacaaccaggtctcgtgtgaactcagagtgagaactcattcattaccatgaggatatcaagtcatgcataagggatccgccccaacaacacaaacacctcccaccaggtcacacctccgacactggggattacaattcaacatggggtttggaggggacacacgtccaaaccatatcagaagccttcagacaagacactactgtttccttccttcccaactgatttaacgatgacttccacattgctagttatattcctggaccccactggcatttgtgttggaggccgggacaagtcgtggctcatgctgcttttgccttttgatgccttgtccagccagagaactcctacccttcaggcctagctcaacttccaattcttctgtgtgtctgtgcctcctgacagactcagtgagcatgagcagctcccttcctgtgtccccagattgttcaaggcatatttcaacagatgaattcaattcagcaagaaccttattgagaacccactccatgccaggcataattctagatatgaggaaatataaaaattcctgccctcacggggatcccagtctcctaagggaaggcaagcagtcaacaagggaactaccgagcatgtcagcaggtgctcactactgtgaaggaaaacaagtaaccaaatgtctgtacttccacccaaaactgcagagaacatggtattagaaggtcactgccttagtcattacttatcttcaacatcaattaaacaaaactgacgcgttaggatgtcctctaccactgctgtaatggcaaaatggcagacaggagtcacttcactagaggactttgagaaggacgtgcttctcagcaatgaccctgttcactcagtaggtttatattaaatattgtgactacgcacacacagatacaattttctcagttccaaaggatgtttcctataagttattattggccattttaaactgtgagagtgttggtgctgactgtgacgacagtggtctcaacagcagcagcagctaagctgcactgggcatttaccatgtgctgggcacttcgctaagagttcttcatggcttattatttaatcctccctggatcttttattatccccatttacaaatgaagaagctggggctcagagaggttaaataacttgccccaaatcacacagtcttcaaactactcttgggctcaaatgcaggcatatgaaacgagatctcaagtgcctattcacaacactatatggccctgaaccagttgccctttagaagaaaccagagtagaacattcattagatgacctgatttcctcattctactggctcagatggttctaccaggtatatatatttgataccaggtatcaatgtctaatcacagaaccacaggaagacaaatcctaagacagccatttcatttatctacacaataaaccatcctgacactcagtggcttcaaacatatcagccatttccctgttcaccctatttctgtgggttagcaattcgaggaagggctgggctgggcagtcctggctcagggtctctcacgcggatattgtcaaaaggtggggagagctagcaaagcggggagctggccaggcacctgctccccaggcaagctcggggtgcctgcataactcactgatcatggtctctccacgggggcttgcctgggcaccgggcctcctcatagcttggggctcggggcagctggactatttacatgaaagcttcaagagcaagtgttccagccaacgaggcctcagaagtcacctggaaccctactgctagactgtcttggctacaagcaagttccaggcccacctgggtagaggggagggggccagactccacctcctggtgtggaggtggtaagggcccacttagaagagcatgtggaatgagaggtatcactgaggccatctttggaaaacagaatctgctacacaaacaagtaactcaagactcatttatagataactgagtttacagataaaattggaacaccctacccaaggtgaaggtaacttcaccttgacactcaacagttgcagttactctttaagtcttgaatctgctaagacagatgacttgctattttacctgaagtctatttgatctcttgtttggacacatcaagagcctttcacattcatctactgaataaagcgcataagtagataaagccaaaattgctcaagtatgtaagaatcaagaagaatccaagtaatgtcctctcctttgtggtcgaggaaaacgtaaaacttcaagtcaagacttaaaccttccagcaccgtttcaaatgtgatcatttcacgtgttctctttactccagaatgagagaaggtcagagctggaagggcttgaatgcatttagctgggactcttgcctggtaccagaacctgcacagggcactcccaaggagacgtgcactgtggccagcagctctgccagcccatgcaggctgcttccttttcctgagttgttacctttcgatgaatttcatcagtcagtgctagttcttcctttgtccaaactgtcaccctgataaccacacccatttcttccatctgtttctgtgcataacatgctttccagacgccactgtccctgaaggcaattccctgaacgtactccttgaaaacatgacacccatgacacccaggcccgcacagagccgttcaagcacagtcacctgtgaggaacacaagctacaagtctgttgctttcagcaagtgggcacagcctccctgacaccgcccagcctccctgacaccgcccagcctgcgctcaggacaggtgcgaccagacacaatttggcttaggttaaacttgtggtcaggatacatgtcctaccttctaactaattttcatctagctgctagcaaattagatctttctagaagtaaatgactgtacatatcttcctaagctttcaccttaaagcagtgaaaatgttttggccaactgtcccagctcacagtgatcattttgaatcaggattctgttatcaatggtcaaaatgatgacaagaattactgaagtcatcactgttgggaaaaaatgaattttggaactcaagtgtattaattggcttgtttgtgggcttatagttctccctaactacaaggttcttaattagaagattactttggtgtccagatgtggagtggggggagggtagagcgataggtgcaggaagggggatccacctcctataaacccctcttgaaaatcacctaaccataaatgttgggtatcagtgtgaaaattcagaaaaggagaaacacccttgaattaaaaggcacttgaaaaatgaaggcaataaagagactcttctcagtgatcttccccatgaggaacttaaggcattgaatccaaccagaaaaatgaatggtccaaaatacctcatgaattccaccaagcaaagcagaagcgtctgctcggaattcattttcagactggataatcagcaagcaatggggaaaaaaaggagattgacagagacgagaaaggaacacaaactgcaaagaagtcatgctttgcctcaaaaagcaaaagccagcagaagaatttcaaggaaaatgattattgatttggtatcctgggagagtgaaactctcatgagggttctaattcaatcaggttagagaggtgaagaaaaggagaattattttgccaggagcccatgccagaagcatgctagacagagaaacgaagtgagaatgctggtaacacattctccatcctcactctggtttcggagtattttctctagtgataaggctcaatccggaaacaagctggagagaggaaggaaactgggaaggtgggggagggaaaaaaatgagagaggaaaaaaaaaaagagtagcaggaagttcaaccagataggaactgatggaatttgtttttcagtgtctccaacttcaaattgcaaaccaagtgagagaagacacacgcttatgtacacaggccccggcaggcaccggtcagcacaagtacctgctgcaggtctcaaggggccctgggaatctcaattcattatcttcgatcatttctttgtctccacagaaagtgcatacatctccaatttaggtgcactccaaaccagttattatcttccaaatcaatatacaacaaagatggtgggaaaaggaagaacttggaaattagaaatgtgcaaccagccgtccccacacagaacagtttatgagaagttttctgagcaactggcagttcgtgatgatctttcaccattgaagcaagtacttctgaatagccggattcagcagggaaacagcgcctcctgacagctgctgtgtctggaggaaatacgaagcaccaatgaagtcagaggagagtccttcaagcagtaggaatgctttatcttctgagcaatgaaaaacagccacagctgtgaaaaactattctagagtgaaatgcaaggtctgaaagccagtttctggcaaattggattgatttttaaaaacataaaatggtgtgagcaaacatttattcaataatcctttctcaagaatccacaagtagattgtgcatggcgtagaatgtagattatgagtacttcctactctcagagaagaaatacttatttattagaacgtttcaaaaggaaaagacatttcaaatatcaaccatgatgctatacaaaccatgatttttatggcaacaaagtccattttttaaaaagagaagaatgatgaggcttcaactgactgaatccctaccacgtgccaagcactggagccagtcacatgctggggacccaggaatgagaacaaaaatcctctctaaggtgttcgctagccagtgtatgccacaaatgaaaaagtccacatgtaaaacacagtgaagcaatttcttctttttcttcgtttttttgagacagggtctcactctgtgacccaggctggagtgcgatggcgtgatgatagctcactgcagcctcaatcccctagactcaagcaatcctcccatctccagcctcctgagtagctgagactacaggtggatgccactgagcctggctaattttttaaatttttggtagagacgatgtctcactatgttgcccaggctggtttcaaactcctgagctcaggcaatcctcccgcctcggcctcccaaaatgttgggattataggcacgagccactgtgcccagctagcaatttctttattagacgcaaaaaggtcagagagaggacagaaagcatgatttaagtttcataaacatgtcctagaaatcttgcatttagcttggattgttgtttcgctttgatataattttcttttaatttctatacattatattcaaaataattaagagagcacattctttacttggcatagtttgttccactacacaacacaaagttcattcctactatgcgcacaaagaaaatttacattttaagtaatttttttttgaatgaagacttttaaatgcatagtcttagattttaaagcttctttttggaccaaggacaccttcgaaaatccaatgaaagctctgcacatgggcccacacatgttttgcatgcaatttaaaggaggtcacaaactcactatagtgagtgtaccctgagatactgccaacaccatgagctctccaacaccagcaggctacagatgacaaaactggtcacgataccactttgtacttacatatcacttcacagtttaacatacccctgaagttattaagtaaatgatttaaccaattggagtgaactttaaagacatcaaatgatttgatctctacaaggagttctctaaagactcataaaatagaaaataacactgagcatggctaagtgcaggaagtagatcatggaaacgacaatcggcctttagcactgggtagtgacccctgcagatctgagcagcctcagcatcaaacggagagaccatgtggtctgtacacacgatattccactcctaatcagacgattctgtcggcagctgtgattgtcagggtcacgggcggtgttggaggggtatgcaactatgattggggttagcacaagggaggccttggtggtaatgaaatagttcaggatcttcactgagataataatggttacacaatccacaaatgtgataaaggggcacagagctgtatgagcagatggtaccaatgccaatttcctggtttcatcatgctgtactgtagttacgtaagatgtaaccactggggaaaaccagatgaagggtacacagaacccctttactatctttgcaacatcctgttcatctataaaaagttaaagaaaaaaccctcatgactattaatcaagggctgcagatgtttcttagatataaatacattcagatcatccagttcaatagagagacgaaaaaatacacaagcaacacaacatctatgctccagatgctcaagctctttcttaattcagcctccagccaataaggaagtcaagtcgttcttcaggctggcctggacacctggtcacatgcttgtcaacccctaacagctcacctctgactacaggtaaggtaaagaagttttgaaatttaaaccattattttccacaaaatagcaacagccaatcattttcccacaaagttacgatacagcatcaaccactggtgtctctggtgaagctcaacagaagctgctaaggcctaactaacccccttcaatgtagattttttgttaaatgagaaagagttcattaacttcggcaggactgctgtattatcggagaaaggctgattttggaattggacggacacagatttaaaagcccacgtgtgccattttggagcattctaacaattctctctgtgcctcagtttcctcactgctacagaggagatactgatatttacatgacgggattgctgtgaggatgaaatgagaaaaatccagcacagggtttggcacacaggtgcttaataaaattggaattctacgatggcagtcaggagctgtagaaattaaaatcagtaggcttcccttattgcaagggtgatgctgttacccaagccaagaacatggttaacgccaacgttctggaactctggatgctgaagacagatcagcatcggcacctaactagagcacccacagagctactgctaccttagtggcccgcactaccacggtttccaggactctggagggaggtgacctccagcaacaccttggcctctgcaatgccaaatataaatccagaccgacggagctatgagagtcaagcgaagcaacaacatacaacattcccgccaactgaggatgggagccgaaagaggttgtattttcaaacaaatctgatcaaagtcctcctgcctttgactataagggctgttgtaactaacaaggttaaggtttcttagcaatagtctactcaaggaaggtaccggtatacctcaataaaagcaaacttaacatatgaacatccacaaggatgtcaaagataaatgtagaggtcattttgctttatagaaagatactctgtttgtcttaaatgtgattacatttaaatagattctgttttctgcacacatgcaggcatgtcaaaaggaaaatactgcctagacgcgacctcctcagtgtggcacacaggtcagcagcagtatcacctgggggctcctcggatggggatgtacaggctctcagcccccgcccaggcttcctgagttggaatctgcagtttgacagggaagacctgtacacacggcaggacttgaggagctctgtcctcagggttactcacgacccggaagccagaagctctcagtacagctgcatggcaggctatccccgtgttctcaaccctcgctccttactgaacgtcagaataactgctgcaacaattggggaggaattaaaaaaaaattttttttaaatttttctccttttgtaatatagatacctggaccctgaccgaagatttaatttaatcggtcttgggcagaaccctggcattagcatttgtttaaagctcattaggcaatgccaggacgaccttgttgagaactatggctacagacggagagcagggcctggtagaagaccacctcaccaacaggtaggacctaaatttatcactggaagaaaacactgaactggaagagagagagagatgtgactaatggaaatctcacacaaaacacgatgttgcatcaaggttgatcatctctacacacactggaccaaaagagattttcctggggctagcattagggaactgcttttgaagctcctcaaacacaggtggatgtctcactttaacatgacttagctaccaaagagtcaagtaacaccacacagtgttgaaaacctcaaggcacccaacacccaataaattctcaaacagaaatctgccagaggatcagaaacctctgatctcttacaactaagagctttctgcaccaaacacataaattctcttaaagttctacaaaagcccacaagtaacatttccctccctgatctgttcaactgtacattttcatagagggtgtccgggagggcaaaggctgggggtggtgggtgagcagcaggcagaagagaggatcaacgtgcagggatgtggaaacgccagtacagaaggcacgtgagccccacggggctggggagatgggggttatctcaaggtatgggagggacgtggagttgatacaaaggctcagggtgtgatcgtggggtgggggcagctgttgggcagagcaaaggagatggagttcaagaggcgcgggactggaattctagttcttcctgaggacacggagacgactgagagagtcaaggaagaggggttggagaggaggctgggataagccagaggccatgtccttggtgaacaaggaagagtggcgtagtccaggtctcacggtgagcactgagggcagaggtacaaccagaagccagcctgtctgaccatggctctttccagcagccccttgtgaaggagcagccggcacggccggatgtcagagcggctcctccctagtgaccactgcctatcccgtgactcagcatagtccgcgcaggcaccaaagccaggtatcctttcccagcctgctgcttccatctgctgagggtgcaggggcagacaggggctaaaagacccaggaattcagtcccaatctgcacagggaatcatctaatgagacttctaaccactggtaattctggactccctaaaaattattactattaagaaacaaaccaccaccctagaaataaagatttctgtcagtctggaaaaatgccaggaatcaataaaccaagtcttcttttttgttctatggtcaccaagggccctggctacaaaccaataaaagatcatcagtacaacataccagattagctgagtaacagtggtcacaaccatatattccagattttctcagacaatgccagttctaaatacttttagcctgttatctttagaaatccataatcctaatatatctcaaactatatccagggctgtctcttacacttcaaaacagcacaaaaaattctttgcaatattatacagcccaatttaataattagaataaattatggagttcattccattgagggtgtagtttagtcaccccattcttttcttctagttgtaaggcaaataatattgtataatagaggaaatacccatcaaacccccttatagatggtgctgatctagcgctgtctcaaatgctgttagaatgggacaggctggttctagagaatgaaggtgacatgcttcctcccacctccattccaagtggagtaatgcagtttgagcagaacagacaaaatccctccccttctcggccatggaagagatattttcccctctgattgtatcggcaatgggtgttcttccccaagtttaatctagtcctcacaccaaaacaaaaagaacaaaagccaaacaccagaaaacacttattcttttttttaaagattccttataaaacattatctacccactaatattatgaaaaggatcatatctaggctgtgcatgaagcctccaaagtgttttggaaagtttgtcagaaaagtactagtcatagatagaaacagtcctatacacaggtgaaaatcagacagtattaaagcggaacacggaaactgtacgtggctttatacctcgggagtcttcttactctgtcttttcccaaaaatgcagtcaagatctgttttgctccgagatgacagatccttccctagaaaaacaatgtgatgcttttcagtaagactgttcttcctaaaagaaagagcgcagacatgaactatgcagcacctcaaaggaaaatggcttttgggaaagaaagaaacaattttgaaactactgactttctacccactttttcattacaactctttcattagtaaacaaaattaattaaattttaaaaccaagtaaatgttttagaaccagaactcttgacattctcttaattgtagaaacaacctagagcatactgactgcaaggaaagctaaattctacagctcaccctactcccgctatgccctcaagatgcaattcctgggtctctgggttcttcatttaaaaatagatctcatttgcttcagagacatgagctacttacttagaagattacgaaatacacatgaaaaaatatcactagatacacagctccagaccccacatatgcacatgaatgagaacgtatcatatttgacacacaggatcttaataattaactcaacaaataaaaattttaaaagaatatatgtaaatcaaaaatactgtaaaagggtgacagggtttcagatttttcttcttaaaatgttctttactgctctagctatattgtctctaaataaaaagctacatagggagagtaggaaattaaatggctctatggttcttatttaaaacactaaactctttaatttcaaacccccaaaccaactaatttaaaattcacttctttggaatttccacttctacccaataatcctctgtgagcagtaggccaaatctagtcccatttgtcaacggcatggtaaatgcattttaaaatgtaactactccatgtaaaggcttgaggctctgggcgagggaggttctgggtcagacacaggaatgtgagtctcacgctggaagccgagttccaccgtcacagactcacttgtcttcttggtttcctgtagcacactgccttggcaaagtaatgtcatgacccagaaggttctagttcactatcactggggcacttaaatatgatattgctcagtgactccgtgaaattaaaaaaacaaaacactcttcaatttaatgcaaaaccaggtgccaaaaccagtttcctaggcagcagtaccagatgaagtggcccaggcggtatgacctgttcctgccaggagggcaggctcctctgggctctggctgctgctctccttcctacctgagcttgacactaagccctcctgcttttcatttatgattaaataggacctacacaaaaagacccaaaagaaaacctacttaagaatagacgatgcacaccacagatacggcagaaaatgaaccgggaaagtggggaagaaaactggttgtagcgggaagaggtggacaaactcatcggaggtgtagagatgtcctcacagctttgctgccagcacaacccattttccaatgcaaagcacagtttgtacttcagaaaaggcagctgtacttaattcaaaatgtgtactggccatctatccctaacctatcctctggaatagagacactctagaaaatgcaaattaaggtctcttctatagcaatttgactaaaaggaatgctggagggattaaggaagagagggtacatgcgagatcacagttctaaaacatgatgtcaaaatgtgaacacacagattcaaaacagatctgaaagtcaaagggaaaactgtcaagctggtagagacagtaagctatatcaatgaaggtgcaaatgtgtctaaagttttgatgatggattcttgtatcagaaatttttagcctttagcaaagttcacttaagtaaatgtagaaaccaggattgttacaggccttgctctggatttgatctggaaaacaagaacacagagaagaaagaagagtcagagaccagtggaaaggaacataaaaggtggacaaaaaggtgaagatggaagtgaccttgagatagttactaattaatggtcctgatggaaagcttataaacaccaggaaattatggccgcttttgaataaatacgacaaatttaaaaagcatttaaaaagcttatttgtttgagttctgaattatggtcaaatcatacaaaatactgttgataaacttagagaaaacgacaatgaagaaaactgaataggaaacatctatctggatttggttcatctattagtcttcaatgcgtaacatttccagaaccagtaagaaaggcctccaagagtcaaactgaaagttcctgcaaggatgagcaggtactttcaaggaagaacactctatttaggtttgctttagctgtttgtctaataatcatgattatcagtttcccagtctatcagagtagctactgggaagggaggaacattactgctatagtcagacacatttacaataccaagaaatacacatgggaggcaactaaaactttcattgacacgagaacttaggaatcaagatgatttggaaacagtttagcaataacccaacaagctgtattagaactgaggctcaaaaaaccaactctatggaaaagcagagttgagctgccgagagtaaagaagtgaagggcaaggaatatgtttgctaaaataaaaaaacacttaaggtttatgtaggtagcttcaatagtttagaaaattcatttgcattattcaatcaagaaggacaaataaaatgacatacttttatttttatctttttaaatggcaaacacacagaactggcagtcaaccgagggcagaagataagggtaactccactaaaagacaccataaaccaggaaagtggaaagagtcagtgtgagtgacacaggtcagacctaccaggtgctacctgatatttatttaaatgtcaaaagaatcagaagaggagattgaatgctcctcactaccagtgtgcaactgaggggcggggctgactgcgctgtgaataccaattctgtatttcccgaccaggaagccgagcacctgcacatgcgttaggcatgtagtttccttgtttcagtagcatataaaatagcccaaactctcaaaaggattaagaagtctgcaagattcccaggataaagctgcacaattacagtttatgcaactttcatccaacaactgcataactgaggggaggaagcactgctctcctgctctcctgccaacgtctcaccatccagtcagaaaacctcagaaatggctttgtatcgattgacattttcccctctgcagatatagcctctatctgcagagaccttttgcattaaaaaaaaatacaaaaaactacaaaccaagctggagttgagcctttaaataagtatgataaaactgacatttaaaattatacaataaattagctcaagttagaattataaactcaggaccagggaaaggaataattatatatcagaactaaaacgatataaccaaccaggtgcagtggctcacacctgtagtcccagcacgctgggaggctaaggcaggacgatcacttgagcccagaaggtcaagtctgcagtgagctgagactgttcctctgtgctccagcctgggcaacagagtgagatcctgtctcaaaataaaaataaaaataatgatacagctgatatttaggcagtagcaaattttacaacactatttgctactgtaatcttagtagagtaaaattttaatcttcactcttcccaagctatgtacaattgcatcttcctgtttgatttcctggacgatacatgagttgcaatatgaatcatcctcatcaactaagtgaatgagttacagtcgttatcagcatacccactggcgaaaatctttattatctacaatgctgaaaaagcaaaagttccatgaaatgggtcatttctaataaatcataaaacagaacctaccttagaacttaatagtcacttacaaatgtatccacattttacaaaagaggaaactgagtctgaagggaaatgggtaggtgacttgtctgagcgagtaatggccagagtgagattttctgtgatctaagatagtccaccctagaggaaactttaaaataagtgtgcaccgtgattggaaagctagctgataaaccattcttttcctcactccctggacttttgcttccttctccctttcctacgtaggcccagtctgcatgtccttcccgtctccactccagctcttctctgcaatctgacaatagatccgagaatccttctgttctgcatactgactccctcttctccccaggcaaggctaatagatacagaaccctcgctggaagacagaaaacgaaggcacgaggcactcagcggtctcacagggtcacccagcaaaggagtggcttaactagaaatagaaagcagatgctcccggcatccattagattaaagcagattacagaggcttatcccagcctcagcaaatgcttcagatgaaatcatgcatgcagtctggcatcaaaggaaaattagaagattctacctgtaaaagtgaaagcgtaaaaggctgccacatcatccgaaagttacaggtcactgagttttattaatttgctctgcaacagcaccttctgtgatctctagtttttctctacagtctaatgaaagaagaaatgctatttcagggactgggtatgaagtgagcatgtaccctctcttcaaaaggactgagggccaaggaagcctgtattctgttccatagcacgctggggtggagaagaaccccagtcagaagggatacgggcgacagccaagaaagttccatgtgagagaaagaacggaggaagcggaagagccacggctgctggagagggaagggaggcccagcctctccctgcacacaatccccaatccactcagctctgccacggcctctcacctcaaccaaacccagccctcacttttgggctcctggccctaaatgaaaagcatcatcaatacttcagagtagtggggattccagctcccactgctatccaggctggctgtacaagttaagagcttcccagcaatgccctgatacgcatgacattcctagaagaccaaagcagagatgtgctgttcctggcatatcaaggtagaaacacatccaacctcccaggaaagaaccatcaacagagactagatattacagcatcagcagcatcatcacgcttcttatgtaaactatgtaataagtaggtttctaattcatgatactgttctacagacaaactggggagttggttctattaggttaaattgcttctttccaatgcaagatcgccacctagtggctgaagacaacaaccgcatgcacaaatgatttcacatactgggaaggggctagggaggtggtgatgaaggaataggaattctcacccaggtctcaaacggctttttacccgacttggcaatgactatggaatgcctacgctgtgaaatggagaaattacgtggaataaagggtcaaccagggagtgtgctttatcacactggaggtatcaatatagagcataattctctaacctggcgtattaaaagctatttaacaccaactttcagctgtgaaaaaacaccatgcagctaaaaatgttgggcaagaaattaaaattattttctgacctagctacataaagtcccgttttcctctaaatataagctgattccattttttagctcagccacaggacttgtttacagtctaaaacctaatctgggtcccatctcagatctcctagatctgaattctaacaagatcctcaggcacaccacagtcaatgcgaagactccagcgctgtttcacagcaatgcagtcggagctgtccataaagcatgaagtcgctattggcccagagctaaaatgcttcaagcaactcaggacaaacacgtagatttcaataacaagtaaagaaatgcttaatcttaccttttgtgaatttcatatagtgaacacggtttttggagattttggacttttcctcaaggctaaaagatttcttttccttcttgtccgaggaatctttaaaaaagatgaaaaaaatacattaaagtctttctaatccaatctcatttattctcctaacagtggatagtcttgaaagaaaattttaggagccctatcattaatgattgaactctttcattcatttgctctgcaacagcacccttctgctggatctctgttttctttctaggagtcaaatgattagaaatatttccttaatttgcatactatggatcaggccaggctgccctccagaaatttagaaaatccttgaggaagaaatggaaacttgtgttcacacaaaacctagacacaaatgttcacattagccttattcatcatagcaaaataccaaaaatcacccccaagtccttcaacgtgtgaatgcatgaacagctgagcaacccctgggccatccttacagtggaataccactccacagtaaagagcggcggccgctgccaccgcaatggccaaaacaaactccagggcattgtgcttagtcagaggtccatctacaaacataacatatgactccatctacagaacattctcgacatgacaaaactacagagagagaggacagatgaatggtttcgaggggacaaggatgaaggtacagtgggtacaaatacaaagatgaggcatgaggttgctgtgccgtggtggccaatcctgtatcttcaccattgtggttgctgcatgaatctgcacttgtgataaaattgcacagaaccatccgcccatgtacaaatgaatggagaccaaaaaaagatgatgaaaactggctaaggtttgtggtgcagttgacagtaacaccaaatgtcaacttcccggttgcgaaaagccacagcaatgtaatgtctctccaccctgggagaacagggggaaagacgttcaggactctctgaattattttgcgaattcctacaagcctgtaattatttcaaaataaaaagttcctttaaaaagtaaataaaggtaagacaggttaaatgatcacctaaatacagatcagagatgacgattaggtgacgcatggaggagcagcaatagctccaagccaccttttcagggtttcgggaaggacaactggaagggcaaaaggagcaggaacacaccattgaggaagacatccgagtggtaacgcctttgacggaagggaaaatgtgagccagaaagtaggtccttgcctgaaaggttgatcagagcaggttgatctggggttagagtcaattataaattagctagccacctgcattctctcacctgtatctgcttgtcaagttcagacagaagagtgccacagaaacgatcataggcagaagagagactaaattttcctacagttttaagaacattcagatatgaggttagagaaactggaaaaaaagcagccgggcgcggtggctcatgcctgtaatcccagcactttggtaggccgcagcaggcagatcatgaggtcaggagatcgacaccatcctggctaacatggtgaaaccccgtctctactaaaaatacaaaaaaaaaaattagccgggcgtggtggcgggcacctgtagtcccagctactcaggaggctgaggcaggagaatggcgtgaacctgggaggcagagcttgcagcgagccgaaatcacgccactgcactccagcctgggtgacagagcgagactccatctcaaaaaaaaaaaaaaaaaaaatccaacaaaccaaccttcttcagaggatataagagaaattggaaaaaaagaaactctcaccctgacagtggagcgaaacaagcacgtgtccattcaacaacatgtgactgcactgcaacccctcccaggagtcacttatttcaaaggtatagttccctatgggaactatacagcaggctcgaaagaacgtgaaggcagatgttccgcacttgaggcaaagcccagcacgggctcattatttccacaagctgaaacattctcttctgcagccacttcccagggacaccttggattttttgcaaagacatcctaccagtaaattcttctcttttgcacttcatatggcacataacattttcaatgctgatgttccaatcacaaatcacagaggaagttatcagcttaaagcggctcctaccgactgcaagtgtatgagggacgaggcgctggactggaggctttccatgaattcttggatttccttcccacagccactccataagagagctgctgtgatgcctgaactcactacagaggacgacactgataaggcacacccaggaagcccccgcgatgggaccgaagcccaggcagacatgacgcagaggccacatcctgaagcaccacgccgtgccctcacagagcagctctctcagccttgagagggcagaagaatcacctggtgagcgtctctaccttctcagcatgcaggtatcaagaaggatgcgtgagcaccgccaggccttgaggaatcactttctatctatttgttcacgtgcactcatgcctgaaactgctcggagtctgacttatgcaccaatctggccgtcctttcccgggtatcccctcccactttacaaaggaaaggcacaactttcctcttaccgggatcaatgagggacaagggaaaatactgttgtcaaagcagcaatcaaagcagctggcccggccctcacacccctacgctaacccagctcatcaggaggtgcactgccaaagagatgtgtttaataagcattcattaaaatgtataacagatctgctaattttattcactgtgatctactaatcatgagggtaggtgcagtggctaaagcctgtaaccccagcaccttgagaggctgaggtgggtggatcacaaggtcaggagttggagaccagcctgaccaacatggtgaaaccccgtctctattaaaaatacaaaaattagccaggcgtggtggtgtgcacctgtaatcccagctactcaggaggctgaggcaggagaatcgcttgaacccgggaggcggaggttgcggtaagccaagattgtgccactgcactccagcctgggccacagagcaagactccatctcaaaaaaaaaaaaaaaaaaaagagagagagaaaataaaaccctagattctttatgaaatccttcagagtaaagtaaattttctggccttaatcgtggtttatggctctagatttgccagccacactatcaggaggcttacagtgctgagtatctctgcttgcttttcttagatgttataatgcatttagtcctcacaacaaccttccaaagatgatactactgcttccatttaaccaaagaggaaatcgaggtacagccatgttcagcaatttaccgaatgtcatacaaatgaaaagtcagaccaggattaaaatccaggcagtctaactctggtgtttgtctctaaaccactgcattctatttaatctccaagtcttatatgttcatgcttacattcttacattctttttttttttggagatggagtttcactcttgttgcccaggctggagtgcaatggcgtgatctcgcctcaccacaaactccgcctcccaggttcaagcgattctcctgcctcagcctccaagtagctgggattacaggcatacgccaccacgcccagctaattttgtatttttaggagagacagggtttctccatgttggtcaggctggtctcaaactcccgacctcaggtgatccgcccgcctcagcctcccaaagtgctggtattacaccgtgcccagccaagcttacattcttatctgtgtttctactgagttcaactgtgatcgtaaatatcaagatgttttctgtgtataattagtaaggaatagtgtccttgaactttactacttcatagatcctgcatttcctaatatgagtcattcagtattttcagaaaacattttccttatctttttcttctgctaataaattattgcccttcatattaggaccacacacagaactgttaggttatttcaaaatcatgatcctatggataaggaaaactgtccaagttatacattccaacaaaaagtccaatctggttagaaaaaataccaacaaagcacctttcccttcacactgttgggctcacttccacacacgtcactgcaataaaccttcctatggttagatgtgtgctgtgattttaccaggtaattaccagcatattctgctagctacctccaagcaggactgtgtcttatacctctgcagatcctcacacctaaactagtacccagcacacagctcaataaatgtttgctgaactcaagtctaattcattatttcactccacaaaattctttcaatctaccaaatatcttttgattattcacacatgacacacaaggaatagactgttcataaacaagaatgtttataaaaatgcttgcagattacaacaaaatccaattaaaaaatgggcaaagtacttagacacttcttcaaagaagatataaaaatggccaataagcgatgaaaagatgcttaacatcagtcattagggaaatggaaatccaaatcacaatgagacatcatctcacacccattaggatggctattatcaaaattataaaagataattactggttaggatatggagaaattggaactcttatgcactgttgatgtagccactacagaaaacagtacggcagctcctcaaaaagttaaaaatagaactactatatgatccagcaatccactcccaggcattacccaaaggaaaggaaatcagcatgttgcagaggtacctgcaaacccacgttcactgcagcactattcacaacagccaagatatggaatcaacctaagtgtccaccaacacatgaactgggaaacatgtggtgcatacacaccacggaatactatttacccttacgaaagaatgagagtttttcatttgaggcaacatggttgagtttggaggacattaagtgaaataagccaggcacagataaatatcacatattctcgttcatatggaaaagctaaaagagttgagctcataaaagtagacagcagaatagtggttattagagctgcgtaaggaaaacagctatgtaggaacagctaaagattggctaatggatataaaagtcccactacataagaggaaaaagctctagtgttctatagcactgtagggtgactataataaataatattttattttatattttcaaatagctagaagaacagattttaaatgctcccaacacaaataataaatgtctgaagtgatatatatgctaattacgttgatgaacataacacatgtgtacattacaaattgtgcacaggtattgacatatcacactatactcaataaatatgtataattatgtgtcaactaaaaataataaaagcaaaaaacaaaaagtagataaacatatttgcattgagaacttatgtcatctgatttccctacctgtggtttcctgcccatggcaagtgttcagttcggccagaagctggttaaaatcatcctgatgggcaatccagttgtcctgaaaatatcaaagaaatgaacgagaggtaagcctgtagtttacttacactgactgagatgatacattttggaatcaaggaaatccagtggttaattaagaaattttaaatgttccatcaaaatactatttgataaatttaagtggattcaagaaataatataaagttaaaatgctctttatccaggtcaatattaaaaaggggcttcctggaagcttaaggcctgatttcaaatgtgaatgacttatcgatcaagtcaatatatagtaaataatcaacaggcaacctgtgtgctaaatgttaaagtaaaacataatgaaatgactatttttttctcactaggggaaattccatagttgaaaggacaagaaccatgcgggacaaaaaaatgctcttctttgcttggtagaattaaaatcttctaatgacttgcatcaactccaattttacaaaactctgaggaaggggaggaggaagaaccttaagtcccctgaatcgatgagttcccatttgtaaggtggttacctaataagtttattataaaaaaatgaacctggcttttataagagaatgaagatctcccaaaccagtgggaagcagggtttcagtgtacgaatctgccttactcacattcttagcaatttttaagaatgcttaaggtaaaggaatatgaaataggtttactgggcaatgcttcttctaagaaaataagtatatctgtgttatctatccctcaacaactacatttgaaatcaactttatataaactctttctttagtggctaaaaattttagctccgccaatccactactcagagatacggaactaaccaaagtaattcaatttacctaaagtaatttcccagattccctaccagattatgttggctgcaaaaacttagaaacaaaacttttcagtttagatcctttccaaaagggaacaatgatactaaaaataaaaagcgcggtaggccactgactctgagttatagtgccatgcattcaaagcgtcagtgttcaagaggaaacgtgaataaaaagaagtgctgcaccaatggtcagaagcagatgaaccaatcaactttcagatttacaagactgaagccaattatgcaaagacacccaggaggcacacactgctgctcacttcattattgatggtagctccgagtcccaggtggttatttttcacttgaactttaatatgatctgtggctccttgctcctgagcccctaaaccctgtggagattaaacacagagagttagaacattcctctcactgatactcagaagcagagcactgctacaaaactcacagatgcctacggcaggtgttctgagttgatgattctctccattaaatactttcacaaagcaacatgggggaggactctaagtcctctgcatcaattagcactcatctgtaagattttccaggtaaggaaagatcaagtgcaaagacccgaaggtgggaaaaaactcagtgtactgggaaacctcagaggcacccagggtggcttctgcaaattaaggaatgaaggaagtaggatgacggaggggctagatctcacataacctacgggaggaatttggattttattttaaagacaatggaaaaccactggtcttttaaggatgacatgatctaatttccatattttaaaagatcattctggctgctgtacagcaaatgggccagaggagaaaaaggagggaggaagggaggcagctgagagtctgaccagtcagtgagctcaagtgatgacagtggctgaagcagggctctgccctgcatggagaagagacgactggggtgcgggaggctggagaagagacgactggggtgcgggaggctggagaagaatgacaactggggtgcgggaggctggagaagaatgacgactggggtgcgggaggctggagaagaatgacgactggggtgcgggaggctggagaagaatgacgactggggtgcgggaggctggagaagaatgacgactggggctgcgggaggctggagaaaaacgacgactgggctgcgggaggcaagagggcggaggaatcaagcatgactgtcaggtttctggcttgtgtaagtggcagacggtgccatgtatgaaaaatggggaaaacctgggaaaaatatatttgggggaatcaagagttttataatagaaatgatacccttgaaatgcttactcaagtggaaatatcaagtaggctattgaatttacaaatctagagctcagaggacagaactggactcaatatagaaaaatgacagttcccagactttagctaattcaaagtgtggcaagggaatgaatgagatcactgcagcaaagtgcaaaaaaggggcctgaggttgagcctcaaggagccctaataatcaaaagtctatagaaagaagagacagcaacaaatttaggagtggcaagtgaggtgaaaagaagagcagaagagacaatagcactgtggaggccaagacagaagtatttcaaggagagagtagtcaattacatccagcactgctgaggagttaagtaatgtgagaacaaaacaagcggcccactgatttggcacttagagatcgctaaagacctcaacaagaaccatttaagtgtagaggtatcagcagaggctctactggagtcaagaataaatggaaagggaaaaagcgtgtagcctagttgcaatgtctatgaaagatgctaagcatggcagcttaaatgatagaaagttgacacttatgtccaatcctaatttatcatcataaggtcacaacaatttttgatttgggatcaaaatcacttactgatccaaagcataagtttcttccagtctcctaagaaggaagttttcccctaatttctaatctcttttcatagctcagatttttttccgcttttctccaaaatacctttcctttagaccaccccatcttctctagcatccgctggccaaacttggaatcgtcattactccaggcagtgttctgaggatccacagcccacttctgcttccgccgacctgtaaatgaaaaagcattatcatcagcaatggagatgatacccggaaaataccacacaaacatacacatgcacaactttgtgtattttatgtatgtatgtaaaatatgacatacattacaatacagaaattaattcaacactcaacagaatgttagactggatcatttatcctgatttccctaataaatgtatattctagacatataagttgacctcttaagattaaaactgaaatgttccctcataatgtggcaaagcaaatgctcaatatactagagctgggccttccatactccgccatcagcacaactgaaagcacctgtggacaccagcatcctcatcaccatcagcagtagtagcagcagcattacagcttccattgccatgcgttactacatacaaaagaacatgcaataccaaggatgcgcttaaaatagtaaatgccaattattcaacctgagacctgctccaaacgctgtacataatattcagttttcacagtaccccaacgagtgtggatagtaccattgtcactggcagatatgaaaatctgaggcttagagaaagaaatttgccgaacatccccaagcaaaaaccagatcctttaaaccaaccttggtcctactaacttcaaagcttatattcttaattcacaacatacaatagtcattatgctcttggggagagtcaactgtaccctccacacatgtgacctacagataataacaatcccatccctctcattgagatgccctgaagccctctgacccctctttgaacttctagaataacttatctgtttcttaacatccactgtattagggctatttatatccgcctttccggtttcccattagaccatcatctccttagggctcatattcatgtcttttttctgaggcttcattgcaagaagtaaaaaaatcactgtgcccacagcaggcactcaataaatatgtgaatggaataaacgataaaaatgaagaatggaaagaggaagaaaggaggaaagaagagggagaggaaaaaaggaaggaaggagtataactgaattaagggaactgctttgaatctcatcaaagcaactttttttaatgcatataaattactgatcattatgaactccagtttatcactgtcgttttaaggaaaattatggcaaaaataaagaactccaaaggttcaaagcacaagaatgtcaaactgaaaagtagactgtggcgaaatgagaaatttggaggtgtcattatcatttatctgccacatcaatataagcacattgtctcaccatcaacacaacccctcctaccttgcccatctcatcacataattaaaaaataacatgaccccctgtcaaaggggctcactgtggcacacataaaatcaatagaggcccataactatgcacactccagcaaaaataggaaatcctttacaaatacacaggcagaaaaaaaggcccttaacaaagcaaaacaagttgggctcgaatttgtagtgttttgcagaaaaaaaaaggtgacccaaaaatgttccatctaaattaccactttacttatcttggcaaatactcagcataacactgcgtctgctaatgaacaacacaccagagagaagcctgttagccagtattctatatgcaagctggcatcagtgtgtcagagttcatgtgtctatgcagtgcttgccaggggtctttgactagggcttgtacgaaggagacagttttgagaataagctcacgctctgcagttaagaactgcacacgcttcacattacctacttatataaaacaaactataatgcctacacaagagattagctattcaaggtcaattcctctcccctgggaaaatggcagttagcttcaatcaatgggatcacaccagtgtttccaaacaaggatgttgggggggcggggggtggcagtttcccattgaaaatgagtaacactgggttaaactaaatttcatatggaagaatctcccggaaactttactatgcaaatgtgcagatcctcttagaggaggccagagcaggcctgccatgcttcccagacttcacttgaccagaaccctgcttccctggaacatttcccagctctaatggcacccaagtttccaggtgtggaaaatcatggtaaggaaaagactgcctctgagctgttccaattggatcaccttttacatgtcctttgtaattctcatgccacagtctgttctgtgctcagatctcagctttgttcactaacacagaaggcctgactgctatcctttgaaaggcctgttcataacagggaactcaagggttcccaccattcgcagaactggtaagagtggctcattgtgcctgtttatgcaaatgatacagtttatgctgagcacctgctttccttctgcgagccaggaattttggtgcctcccaggtagagggtgtctatgtgaccaggccccaggaaatccctagcaccgagtctctcactagcttccctggtgggcaacattccatatttgctctcagaactcactactggaggaattaagcgtgttatgtgtgactccctgggggagggctctggaagcttgacgcctggcttagcctggactttgccccgtgcatcttttccttttgccggctttgctctacatccttttgctgtaataaatcttagcagtgagtgcgactatatgctgagtcctgtgcctgaatcccccagcacatcattgaatctggggatgatcttggggacccttgacacgatctggaacagcagtgtttacagcatggcgctgggcctcaggtagaatgccctgaatctgcagaatcactatttgggaagtatttaaccatcctctagcaggtactcctatgtggagatctaactgtaaatgggtctgtcgggatacttttggggcaaatccaataaaaaccatccacacaacagctcaataccacatgacttatgctaggatcccatttactctaaagggcgtgttgagtcccaagagccagaggcagaagttttaaacaatctctcaaaattcagaggttgatcagaaggagagtattgttacactaaattaaatttggcctgaggaggcctccgtacttgagtccttacataaggaactgcaacctacgttagaacttaaaggaagcgaaagcctaccgtaggagtatactcttataacatataagtgagcctcaatccattacagcagctaggcttcaatcacaggcagccatctgattcaaataaggcaaatcagagcggtaaccctaaccaagttgtcgctgtacctcacttccgtttactgtccataaatactgcctgaccacatagcaggttggagttcttagaaccggttctagttctgaaggctgcccaattcttgaatcattctttgctcaatcaaactctgtataatttgtctaaggtttttcttcttaacaacaccaatcctaagtatctaattacagaagatgctatacccatttagcaaattacgaaaaagaaaacacaaaaatattacatattataatgacaaggatttgacaatttggaataacgttgggaagaggagaactgaaaacactctcttgaaatcatgtaatctgaattactgatgcctacaaatagcattttacacctctatacttcagacttttcaaactatgttcatgttcaccatctcactgatttaaggccacctagggataaaaatattaagagaagattttgtggcctcacaaacactgatcaaaggaacagacataaatgaatagcagaactagggccaaagtcgccaagtgcatgctgaattaagcaaacatcaaagaatacgaaaaccagaagagatcttagctatctaggctctaaccctgactcctcattttttactggtgaaaaaatagaaccgacgggttcagtctaaaacatactcatttctatgggtctccgctggtcttactggcaagaacataaagatacagagataactggatcaattttgccattttctacctcaatgactaggggcaaattattttcctttgaacgtcaatttctgcccctgtaaaatcgggatggtgcctgacccatttcgttttgtgctcctaagtcctccaccctcttagaaaagagagtgctaacagcacttatttcacaaaatccctgtgctggtctgcttgatctgttaaataagctgtttctgttctttgctcactgtacaactcgccaagcaggacccgcttttcaggatcaaagcatgactgccatctggcggcaagcgaccttcgctacaggtacaattcagaagttcagcagcctctacagagacaggggtttcaccgactccaccaagtgaagataaatgtcaaaggtaaacaggcaggacggggcgctgtggccaactaacaaggtcaaaaacgccagtctcacttagaattacacattagccctgcactccctcgctaagtggctgacgtcccatatttgagacttctaactcctttgctttttctttttctgggtccaagacatcttggacaatgtgattacagtttcaagtgatccttctgctcaaccttctctttttaacctcaggaagctgaggtccggggtgggtgaagcaaccagtccgggaccccacaaagggcggcggcggggccagtcccgggacccggtgttctgacccacttcgcacgcgacccagggtgattctgagaacggcgtctccgggagacacttgcggtctctctcactagcagacctgcggccaactttcggggagctctgcggcgagcaggacaatcagagccgggctcggctccccggtcccccgatcccatgcgccaggcgcgccggcaacccgagctcccagccactccgggctgccgtgcgcgtcacccggcatcttcaccaacgcgcctgggtcgggcctccgcttccgacactcacgttcagccagcatagacatgtcggagagcctgtgataccgccgcctctggacctgggtgactgcggccactgggcgggctggagactccaggagaatcaggacgtgcgtaactccctcgccggcggactgcagcggacggggcgcgtgctggtgacgtcagtagcgcgcgactcgctcctcgagcacgcggcggcgagggggcggagcagggcggggcaacctggggaggtgacgggagaaagagggactgagggggcggtggccgccctgcgggaggtggagaaaggagtacgtattcgctcattggctagagggagtgtgcgtactaagctattgatgtgagtaaagcccgcctgggcgtgtctgccgcggagcataagctcacgtggattacctgtagggtctccatcaggaagccctaggtgccggcaagaagggtagtggaaagacgtgacctgccctcaagcagctcagcctcacggggaaaagaaatgtgtaaagagctgaacttagggtcatggatgttgtatggacaaggagtttgaaaaacttggctggaggggaggactttgcattgtaatgtcccatctcttcctcgtaccctacctctgctttctgagatagataaacaaatggatgatagataaatagatagatagatagatgatagatagatagtagatagatatcagaagataggtctgctatctatcggtttttttgtgggaccccacacaaaatagttgtggggaaaatgttacctctttaaataatgggatgccttcaacaaggcaaaggttttatttattttctccaccacagtgcacacactggaaggttgcctttattatatccatttctgtattcgtaccagcacctcgcaaaataatgtgagtatggtaaggctccatagatgtttgcaaaatttaattcaagtatccctgtctccaggggagttctaataagctcttagctataacacttttaagtatggtaaagacatgtttttgggtgagtgactctccagtaaacttcaggtgacagtgcacacagaagcctttcctacataaaaggaaggtaaaaagagcaccactcaggtgccaagaaaagcaattgaaggactagattcttgtttacaatgaaattctccctttaactaggaatctggatgaaaaaggtaaaccctagtttcataaaagttagaagaaacacaaaaggatgcttatagctatcagtgaatactgagggggtgaggggaggcaagtgaatggaattttcccagccaaggcaggaaagctgtgacattgtgacatagggaacaaggttaaaagtagggcactggactcaggaaggcaggatcacaaaaatcttaggataattagcagatctattggattatgccagagagagtggaaggtagttatatagaatggagaatactgaattagtcggaaatcagagtttttcaagcacctcctgtgttggtatatgatttcagaaaggtaattttgtctctaagatggtcaagaagatcgaagcagacatttatggcctgttgccatggttcaggtggtaaatggttagttatcgttggatcttctgttacaatgaggtgtctcctggaaacgctcagttagaggccacagaggaatattgtagaagggactctgccttttggtgaatgcaggatggtttcctattttgtttcaaccccagcattctatatggctatgaaatattaatggagatcatctactgaaaaagaatattattaagtttgggatttaaaaaaaattacagaatcttgtttgtattttaactggccagctggagtggaaattgcacttgttaaaagaaggtgatccaatgtaacccattccatcttgtccttcagtgtctcagcagactcccttgggcaatacttcacagacatgactgtgcacgccagtcacccagagatcatgttaaaatgcacatctggttcagcaggcctagggtgagtctgagattctgccttttttttttttttttgagacagggcctcactatgttgtccgtgctggagcataatagtgtgaccatggcttactgcagcctctgcctctctgacttaagcagtcctcccacctgagtgtcctaggtagctatgactacgggcatgtgccacaacatccagctaaatttttttatttttattttttgtagagacaggatatccctatgtttcccaggctggtctcaaattcctgggctaaagtgatcctcccacctcagctcccaaagtttcaggattacaggcatgagccagattctgcatttataacagggtctaaaaatgtggataccaatgatccacagacctttctttgcataacagtccatgacatgagcaaaggtatgaatggactcaagggtaaagtagtttctctttttttttttttctacacaggtagttggctctcccaagtacgtagttctgctagtgtggccagaaagcagctaaacaatagataaacactcattaatgtatctattgtttggctgctttctggccacaccagcagaactaagcagttgggagagactgtgtggcccccaaaacctaatatatttactgtctgatcctttaagaaaaatttcgctggcccctgaattaatttcaaaaacatgatgctcagtggaagaagtacatgctatatgattccatttatatgaaattctagactaggcaacactaatcaggcatgtaggacggatttgaatgatccaggccagaagccattctgtacaacaaaagaagccaaaagatgtatgaagagaaggaagactgagataataagggctagatctccctaaggcagagcatcagagggaacactcattcactaacagcttctcctgaggctctggagaggccctggggccccagcgaacttgcttgcagagcctggctgcactcttggtccttcactccctgtgaggtccgattatttgtcttttttcctaccttggttcatttagctgagagtcttatttccttttcatacttctaatatacctcccattacataaggtaagccaagtgaatgttgattcttacaagcagaaaagtgaaatacacatgagaaagtgctcaagatacgtaaaggggaaaaaatctctaggacaccaagttgatcattcatagttcatttaatatcagtaattaaaaaatacatattaaattaaagtctaaaaggtaatactctaattcttcactgaaaaccatatctagttggtaaggttatgggttgttgtttgatcttcctaatgctttttttttttttttttggtacatttttcttcttgatgtgagtcatattttcctgcatctttcacacctggtaacctttttattttacatccgacattgtgagtgttactttattgggggctgaaggcttttgtattccttcaaatattttgttctgggatagttaagtcctttggggaaaatgtggcctttgcaagccttttgtgtaagttttgctagatgggcccacaatagtctttaagtttagttataatctggtcccattgttaaagcagcagcctgtcaaggactctgcttgatgctccatgtgtttagaaattatttccactggggaaacgcaagttgcttttggccctgtgtgagctctggggatttttctgccttcttgtctctggtggttctttcccagtagtttcctccagtgcaagtgttgctcaatcttcatttgaagacttgaggggacgcttctgcaaatatctggagtttcccttggtataattctcttctctctgacactcggccccaagaatcctagcttccttgattgttgtcaccttagctcagtgagacctccaggttctgtctgagttccgtctccctatgctgcaacctggaaactcttcaggccagaaatgagggctatcaaagggctcacctcctttattaccaaattgttaggattgcagtctttcactgcctgttgctcaatgtctcaaaaccattgttttgtctatttttcccagctttgtagtgaaggtggaagggtaaatccagtttctttactccatcatggccggaagcagaaattgctaatactctgactatttcaaataacctacaatttgtatactagctgtgagtacttacaaaagtcaagtatttaaaaagtagaatcattctgtctgtaactggcaaattagaactgtaaaggttttaagccaagaaaccaaattttgcctttgaattgaaaccacctttgctaaaattataacagtgagaaaattatgacaatgaaagagacctgacctaaccaactccatcttgcctttaacctccaagctgcccttgttcattcctgggtgtaggctgaactaactttgggaggaatttagttaatagtttaattttaaaacaaggatgataacagcccctccctgaaacagccccaccatggctcaggtataatacagccagaggccacaagactgctaacctacctatttgctcctatagataacattactattataaaacctaagattggtgttttataatagaccataacattctgcattctgatggatccgctggagccacccaggccagtaaagtggctcgtctggtcttgtggcccctacccaagaagtggctcatgcaagaggagagcttcgactacctatgatttcgtctccaacccaaccaatcagcaatccccattccctagcctcctgcctgccaaactactgtataaaaatttcagtttctgaattttcgggacagcttatttgagtaataataaaactccagtctcccatttagctagctctatgtgtattaaaccttctattgcaattcccctgtcttgataaaccaggtctatctggttagcctgcgagagaaacccatcaggcagttacagaatcaatgttttttttttttctttagtgatgacagataaacctgaaatgacatgatgcagaaaaataaaatatcatgtgctctgaacgactgctgtttaaaaaaaaaactaaacatttgaaagagcatcttaaattttagtagatttgtgtatattgtagacattgggggaggcagggtaaaagaagaagagattttttttttccatgtatttcaagctaattctgccattgatatttgccgtaggtctctcctgcacccttccctcaccaacattttgggttatttctctaattttcctaaagacaactgatgcagcctgtggcatctttttgtgtgtgagcatcccaaaaaaccgtcaccgtgaccttggcttttgaccagtccactttctctttgactggaccatttccatttattggtagccattgctttggttgtgatttgtcttcaggattgtactggtgaagctgtggtttatttcctgtttcacttctccgaagaagtgcttcaggatcttcattccacttgtttagaatttccactgaaagctctgctcttgtctgcagctgatctgggtgcaatagttttggcacccattgaatggaaagattgctcaactctaatttttcggtcagagttgtatacactgaaccaattgcgatatctatggtttggctattgtttctcctgtaaatcattagccctcttcaattagtgcatgaacaaacttagttttttccttgcaaattaatgtggatgatctaccactataggtgtaatctttaacatcatcttattccttcttaaagtaagttatccgcttgtaaactgcttatttctttggggcattgtccccataaactttttataaagcatcagtgatttcaccattccacccaagcttcaccataaatttggtgtttgttcttgcttcaattttagcagaattcatgttgttctgaaagggggctctttcaaattgatgtcttagtgcctcaaactagatcatgttctaacatgttataacaagttattacaagtgtattttggtgcaaaaaaattgaaatccatgcataatatgacctttccatgaagttttggaagacctctcctatgcttatgcatacactccccaaacgtatcaatccagttgctattgcccaaggaacagaaggctcatcactccatggagggtttttcctgcagcccctacctaagaccttctcactttctctgacagtcctatcatcgtgtcgtaaaaggcctgcccacttagtccaacacactggaaatggatgattgacaacatgtttatttacccatcccctgggggaaagtctcagattttgtgaggttgttgcccctgcaatgtgctttaaactcagctttctgttgcttgtgtctctgggtcagaagaatttgtcagtgataatgtttttgttaaagtcctatgcccagttaatgccaactcagcgctctcatcccctagggctcctgtaatcatttttcttgccttctcttacagtttctgtatgttatagaagttcaaagaagacaaactctagccaagagcagtgtgaagaaaagaagacgctatattaatcacagtccagggatgccttctggcttcctggcagcaattccggcctgagattccttctctgtgcatacttcctgtcaacattgtgtgatgtcaagctgtggccgtcacaaaagtactgtgaacacctgtaaatcccaactatcaaaaatcacacccaggaatccaaattagcattattatgtcaaaagaaaaacctgattt

SEQ ID NO: 575 - DNA, 100665 bp, Homo sapiens
tctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtg

SEQ ID NO: 576 - DNA, 101336 bp, Homo sapiens
gccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggtatttacctgacttaatgggactccagtaacccgagtcttcctagtgtagcccccttagattagataaaaaaggatactcagacaagcccttttataaggtgtttaaaagctagtggcaaacaattgacttagaggttggttaagcccctcctccctttatcattctgagtggttacatagaatttaagattttggagcaatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgattcgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccatgttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggagtggggaggggtagcattgggagatatacctaatgctagatgacgagttagtgggtgcagcgcaccagcatggcacatgtatacgtatgtaactaacctgcacaatgtgcacatgtaccctaaaacttaaagtataataataaaaaaaaaaaaagtgcagtgttactctactctgtaggagggaagtggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacctctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctgttgtgagaattaaaatatataaatgggatagtatatgtaaaagtacctaattcagaaaatgtgtgacttccattatagggggcaaaagcatccttcccttcatggtgagttgttgatacacattcaagtgaaagccagtggagattttcagacctgtattggtgatgcaatagcatgttcagcacttcttggcctcttaattgaaaagcctattggaggaagagtgggattgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttagatggctagcttcaaagaattttttctctaggtcaaaatttattaactcaaataattataaaaataaaagtaagccacaaatatccctgttaagtggttaaagcttgagctttgtaagcagggagtcctgagtttagtcctgtttccctcaattattagctctatgaccattaagtcacttaacctctcagtctgttttctcactagtaatgactgtttcacattttattgcagtattgtgaagagatgatggatatataaatgccatttagcagaataaaaagcatttttgaaattacagtaaaccaaatatatctgaaattacctcatttttgtgatataaagatgatatgaaactggtaagggaaagtctaacccctgcaaccgcaaaggaaaattatttactaactcactgaaatcttgattgaaaccatgaagagtttgtgtgaatgtatataagtcaaatgcatgttttccctatacagataaaaccaggattttcttgtggtgatttacccagtttacctggttataactataatggcattgcatattgtgaaagaatatcaaaacctgagattccatttattcactcacttattaaacatatataagacatctaccctttattattattagcaatacttaatatgagtaatgaatgcaaagaaaatcagtcatgaattttgtagtcaagtagcttgtggtctggctgcagagataaggtatgtaaacaaataataaaaaatacaagagagtaagataaatggtaacaggatagaaatggagtgccaagtgtttgagtaaagactgctgagaagatctggttgctgaagggccttaaaagtaaagggaatatcgtgaacaaaggtacaagattaggatgaagagtgagaagttggtgccagaagttaaaaccaccccagaatgaggggacattaaagaaattcaaaggtctaaagtggttaagtaataattcaaatggttctttttttttctgccctagtttatatgacttactgccaacagtacccatggctcagtgaggcttcatacttatagaggtggtagggtatgaatcagaatctccttagagtcctgagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaatttttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaacaagattaaagtggccctgggtcatgtgtcttggtcgagacttacctgtgtctctgaattgtgtttctggatcccagtgtcagctgtgactgtcacgaggctcagaggaatgactcttaccctgtgacttttggttgtttatctcaaccaggtgttgccctcattgtatggcgtactcaaaagaaacagtcataccctatgcaatatgcaggctggttggtagtcactcatggacgaagaccatgttgaatgctatggtgcacactcccaaaagcagatggtttactaggactttacaaaatgcctttcttcctacttctgcctatgccctatgccactatgccccctgaccaaaaaaaaaaaaaaaaaaaaaaaaaaattcctgatcctaagggttatagggaaaagcatccatgctatagccaaggagttctttcaaagccaacttaagcactgggtcctcaaaccctataaagcaactgttggcacgggagagaacctaatcctgattatatgtatttgcaactctggaggaagaatcttacacatatgagcaggatcgagaggaccttccctcctccccaacccctccccacaccaccaccaaatgatatacggtagccaccaaaaggaaaataaaataaacttggatactgggggaaagaaacaaaaaactaaaacagaggttcacaatttgacccaattggaaatccaaaattaaagaatttttgcaacaacaacaaaacaagataaaaggttactatttggcttttgtacctctacaacctaggttccgaattaacttttaacatttgctgaaatgcaccagttgtcaacccttcatagccttaatattgggcttcaaattatacctggaattcccctaaatttaaacaaagtacccctataatcttagggtagttaactgaggatattttaggacatgttaggaagacaaatagatatgcctcatcttaatcagaactattgccctgcctaaattcccccatagccatagcacccattaacttaaaatatcccatagtgggcatggatgctctaacccaatgagtaataaattaaaattgaattaagtctttggcacttacaaatcagcttgccaaaatgggacggcatggaccttcccctcctccgttagttaaaatagttaatatggcccaatttaaattaaaacagagtctttgaggtttgaaacccatataccagacctatttggagaagagtgactatccccactgcttcaccattaatggcccaatgtagcctgttcagaaacctagaaagaatgaatggcatctcacagtagattattgccatgttaatgctgaagttctatccaataaggctcccatatcaaatattatcaaaattactaactttaatcaacaactggtaaatacttttaattcatagatttggctaatattttagcagcgactcagccacaatttgccttcaccatcaaagggatgcagtatccttttactcagctactcatgggataacaacagccaggtcttcacacagcctgcagacaagatcttgaccacatttaactttcttcaggagcacagtaaacactgatcatactgatcacatcatcctccaagaaggttcatttggcacactcactgaggacacatatagtcataatcataaaagagctcacgaaaaagggatggaccactaccccacacaaattaccaagtccttccaccttggataaattcctgaaagctatttagctgagggccattctatccctgacacttgccagaaacagcattcgcaatttttttaaaagcccaatatgttttagtctattttgagttctggagacagcatatttctcatttacaaattttacttaaacccgtttatactattacttaagctcacttatgaattataatacaggcactgcaattagtgacccctgagagtcctttacttaaaggctttagcaacctcctcccatgattcctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtaaagggagtttctccactttatagatggtatcactaccattgtatgtgatggagcttgctggaaagttcctgatttttagcccataactgggacatccctgataatgaaacaggacccaagtcagcacaactggccaaactttatgcggtccttttagcactgaataccctgaccaacatctgcacagttctatagactgttgaaccactgccagtgatttgctcatctgctccagccaatagcagcaaaaacagttttctatccaaggttgcctctttgggttaaataactctgtgactctcttgcctcatatatatatacttatactcaaagtataagtcaaggtcatttctactcacaataaatccacaataaaaggcctcattaacactttaaccccttcagtagtctagaaattattgatagtgactaaggcattcatttcacatctcaaaatacataatattgggctcttgtacaaggcatttaatggaactttcacctcccttaccagcctcaggctgcaggcctcatagaaagccataatggtttattttacctaaacaagttcaagttcaattaaatgaaacatgccacatttcagtcatcagtcaaatatcagggatgaatcgtaataaagattctgactccatttttggtacttgactgctaacaactttcaaattcttctacttactccctcttcttcagcttcacatctgggaaaactgatagggaagcctaggtaggcctacctttggtgccagagggaagctcaatccatgcaagccccagataatatatgagaacctccccaaccttaccctacacccctcacctcccaatccaagccagtctcctttccctgctttctcaaaccatgtttggacctgtttggaagctccctctgctctccctagaaagcttcattatgtgagtgatacatcttttcatatcttcttggtgtgtgtgtgtggtatcatcagcctcaacatctgaagcaaatgttgggtgggggtacatcccactacttctgagtgacaacagatgtttagagttaaatattgaaagaaatttcatattacgataaatgacaatttcagaccaggtgcagtgagctcacgcctgtaatcacagcattttgggaggccaaggaggggggaatcacctgaggtcgggggtttgagaccagcctgaccaacatggagaaaccctgtctctactaaaaatacaaaattagcaaggcatggtggcgcatgcctgtaatcccagctactcggggaagtctgagggaggagaatcactcgagcccaggaggtggaggttgcggtgagctgagatcacaccattgcactccagcctgggcaacaagagtgaaactccgtctcaaaaaaaaaaaaaaaaaaaaaaaagaagagaaaaaagaaagaaaattttgtaagttctgagcaaccacatgaataaagccatgtgttttgtgaaatgacgtttaatatttaaacttaaaactagtaataaatctctaaatctctcagaccccaagatatgaaacttgtttgacacatttaatgattctgtaaaagtgtaagaaatgaagttaaatgaagaatgtcatggcctgaaaggatggaaaggcattagacatgcatattaccttgcctgatccaagactcagggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtcagcctctctgaatgaaataaaatgtctctaaataaaatgtcagaaataatacaaggtatggcagcaggaaagtagcttaagaaaacaaattgcaaaagggaacatttatttttcttctggacgataccatctttttctatgacttcaatcatgtatgcagctacataccaaactgtatttttcatgtcttaccttctttttgatcaccagattggtgtatacccagctgcccattttatattgccagttgtatataccttaggaatcttagactcagtatattcaaaactgaacttggctctaccatacctgctgctccttttttatttcacctaaggaactccagcagtcactcaggcccttaagtcagaaagcttggcaccatgtctaatcattttcctcacctttcaccttctactgtcccatcatgaagttctcatcattctagccacttaatatttttcacatacattaattttttttctgaatcctcatggctgctaaattttaagctattatttttctccttgaaacactactacaactccctaactgatcctcctaactctaatctagcatctcacatatacttcctcccatcccaagtcaagccctatcccacactagccagagtcaaattctaaaatgcaaatgctaatgataatatacaaaacctttaaatgacctttaagtgctcctagcaaaggtacaactttcttaacatggtctatacatcccagtgggatttgattcctgtccatctatctttctaggtttatcttaccaccacttccatcccctctagagctttgctccatccacaatttcttttttcttatctcagggacatttttgtacatgcttttcttgcatcttggaacatttaccttctccatacccacctgtgttggcctaaatcttaccttcttcaagtgttctggaatgcccttttggatccaccttaactgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatatacctttcattgtgtgttatatgaaatatatctcaataaagctgttacgaacgtaaaaatgtgaccttgagcaagtgagtttccacgttaggaaatggagataataaatgcccagcatacctcctggcatgtaatgaattctcagtacatgtcatgtggacttgggagtcagacagtcctgagatggaatcctgtctctgcctattagcagccatgtgacctttggacacatggccttttgaattgccactcaacacacttccttggatgggggaagaaagagagagtactaatcctgtttgagtcctaatattattaactaatggttctctttgggcaattatttttcttctccatggcactccatttccaccatctatatttgttaaattaaggatctttctagttgtaaacttcaatgattctggtgccccataccccggagacttattgaatcaagatctccaaaaggagccttctttctgggcatctgtggagtaggagggaacagcaaggaagaccctaaagacaaaggaccctaaagaggaaagcctggggcctagggctggtacatcagatgaagacaactaaggccagctcctacccaatgtatcaatggtgaagttgatctctaaggcccgtctcagagctggcactctgactcagagccaaggggttgctaggaaacaagggtctagagcctgctggtcagcatcatgcaggcttacatcctgccgatcaatctccctcttttttcgctcttcctgactaagtacttctaattgttgcagggagaagagaaatgccacacaaagagaactttgggagtgcccactttggctaagtaatagtaaaatgtaaatggtaagagaatcggagcatgaaaagacagaagaaagagaaggcatgagagaataccatttgccaactctgtgcctttgggttgtatatcttacccctcactcccaaatctcagtttacttccataaagataccaattttaggaagttgtagggattaaatgaaattgtgcatgtgaaatgcccagcatatctcctggcatgtagtgaattctcagtacatggcataaggacttggaagtcagacagccctaggatggaatcctggctctaccttttattagccatgtaaccttgagcagataagttttcacattaggaagatggaaataataatttggacctcacagggttgttatgaagacaatatgagatcatgtgattaactaactcataataggaactcaacacatgtaaatcattgttgccctttcctctgtcaccttctcttccaacacacatatacgcacatatatacattcttctagaacaatataagcttggtgttcagctgtgcaaacatgctcccatgtgccctactgctgagctccaggctgtgctatctgacattctcaccttctattcccacctccaggtttaggaaaagctcaaattcaaaagctgacagattagccagggagaaacagccatgacataggaagtctggcaggaagaagacatatatcttaggctgctgtagtcaggaccagaaaaggctgtatcattatgccttttgcttgagaaaactaacagtaataataatcattattggcttaattatgtctcatgataataatgaatgatgatcataatagcatttcctcagcatttgttatatgccaggtgcagcagtaatcactttacaaacatcaattcatttaaatctcataacaatactgcaagataagcataattatacccatgttaaagataagagaattgagtcccaggaacctaaaagacctgacctaagtcacacatctagagaatggaacagatgacacatagcttcttatgtatgttgccatttgttgaaacttacacctgtcgggaggagaatgcatcaatgactgacttgtgctgagttcctgctatgagccacgtaatcacatgatctcacatcatctgcataagaatcatgtgaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaagaatcatgtgagatctaaatgtttttccagctattcccctggtatctcccaaagtggccagttgttttcacttaatttaaggcattggagattcagtcttttctatttgtgacagttctcagctgtggacagaggcaatggaagtgtctctaactacttgggagactgaggcccagtgacattcaaaggtctaacaaagaagccaatagcattccctaggagcactgaggggatgcaggtactatattgctcctaactggtccaagagacttcgccattcctaaaggtgccaggccttcctacaaatctagctttgcattgttgtctccttgcgtggagtctccttcctccccaccttcccagttggcaaatgcctactcacccttaggttcctgtttagacatcttttcctccaggaagacttcccagtccaccctcagtaggttaggggcccatctctcagccttgttccctccactccccaccctccatacacatgcacactttatgctttcctctatcacagcatttatcaaattataaagcatttattaaaaaaatctgttcacctattagtctttcccatttgactgtgggatctttgagagcagggactgtgtctcacttgccttagcctccttagcacctcatattaggggctcaaggaactactgtggaatgatagagcggtgagaaaggataaaggaaagaaatgagaggcagacagggaagaacagggccccctggggtgtggtatctgaaaggactgtctgtgagcaaggctcctctcaggttggtaggttagacctgctgataatgaccaagggaaggcaaaaacttcaatgtatgtatctgtattccctccaggccattttgttctcattaaggggctgaaggcagagagatagcaaaagctccacattcatctccagggaaattccacattcttagtgccagactgctgagagaaaagggtcctatctaacaatcctgctccctcaggccctgcatctctgtctgggactgtgactgtgacaggggaatgagtatgattttgcacctgtttgaatcagagtaactagtttacaacagtatcaatctcttgtcacttcccctaggaagacggagagtggggatggtctccagtgctttaggtaatgatgcacacacatataccccaaataatataatgagcagtctgccaatcaaagactctgccatttataagtacatgggaggctttggcaacaggtagtctttgaatttgttctaagttttctggagagggaaggccaaaccatgtttctacctggttattaaatttctcccttcaccactgcaatttctaattgattgcataaagctgacctcatctttcccatctgtagaatgggaatggctaaccaagataagaatggaaaacaccttacacaagtcactatttcttactgtcacacccatgacagacattgctaagtaatcactgcattcttttccactgagcagagtcctggcccagaacctcaatgcagtattccaggcagttgattgcaatgggcacataaagaaaaactcaggcctgactatgtgattgctaatgcctcttcccactctgactttgtaaggtttgactttactttataatgcagccctgaagctaagattcagaagcagattatgctgggagatactggtggtaaagagaatattttcacccctgctcaagctgaaggtctaaattccaagtcttagctttcctaatttcttttacctgtggataagagaaacaacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttatttcaataaacattattgaatgctatcaatatgccaggcactggctaggtattagccaagcaggcatggtccctgccctcacagagcttatagtgcagcaagagagaaagatgtaaactaataaatgtgaacttacaaacaggttatgtgtagcaaaggaacatcattctaagaaaataggaatgtagcaaaggatcctgacatagcctgaggcttcttgaaaggttttctgagaaagtgacatttgagttgggtgatatgaagtgatctcagcaaaaatgggaaaaaaaaatcagcagaaggccaagtgacaaaaggattgcagcttgttctaggacttgaaggaaggtcagtatgacaaaacggcagaaagcacggagacacacagggctgaagaggttggctgaggacagatcagaactgttagagccctgaggccatgggaaggaatttgcaaattatcctcacggcagtgacaaggcacctagaagttttaatccaaggaataacatgatgggatctctattttagaaacatcctataatggttaatttcatgcgttaacttggctgggttatcaaactatttggtcaaatagtattctggttatgtatgtgaggatgattttggagagattaacatttgaattggtagactgactaagcagattgtcctccttaatgtgagtggacttaaaccagtaagttgaaggccccaatagaaccaaaaggttgaccctcccacctgaatgtcttgagctaggacattggttttttcctgcctctggactccaatggaaacatcttcttttgttggatctcaagcctgccagccttcggactggaactatagcattggctctcccacttctcagggctttggattcacactggaattacaccatctgctctcctaggtctccagcttgctgactgcagatgttggaacttctcagcctcaataattatgttagacaatttattataataaatctatatcatctatatctatatttacatatctatacctgtatctgtacatatatatatatatatctgcctataagtctctcgctacatatccatcctgttggttctgtttctctggttttgttatcctggctaatacacatcctcagggctgccgtgtggttaggattcagggaggcagggtagatgcaggctgaccaggcaagagaacaaagctggaatccagacaagctatgatggtgacttggaatagggtggcaacagtgaggaagaaaaaagtgggcaaatttaagagttatttgagaattaaaattgacagaacttgaaatggtttggaaatgggtggctgaaatcagcagaagaccttctcagaaactaaggtacaaagggagagggaagggatagttagccaactcccaccaccacagacaaatgcagccaggctgagatttttcaccttggataaaattaaggagttaagattcagaggtgactgtcctgggatcaagcaatttgaagtcagtgctctcagatcttgagagagggtgttgagaaggattcctaggtttctggttctgcttctaaacagataatggtgcttctcactagaacactagaaaagtattaggttgtgtggagtggagtttgggcaggcaagagaactagaatgatagcaaatatcagaggaaagcttgatgttggaggtataaagtagaactcatcagtgtggggattacaacagagatcatgaccatagaaacaagtctagaaagaggggtccataagacaggctcctgtgaaacttcacttactaatgttgcagaagaggatgaacctgcagaggagacagagatgcaacagtccagaggggaagtagaaaatcatgaagatctagtatcaccgaaacaaacacagaaagtgcctcacacaggaagcagacaactttgtcaaagcctactgaaaggtcaagcaagatggaacccgaaaactgtccgcaggatattgaatcactgaggaagtaaaccaagaccttgcaggtctcagaccctaagaacaactccgttcatatcttgttgccatcttaaaagcaagttccctcgggaaactgaaggctctggagaattatccagctctcatcagccccttggccacatctgtcctcaaagaaaaggcgacagttgaataatcattcccttctcctcctccacccacaacccctgagatgccttttaaacagccaaaaactcctttaaaaagtagtctgggaatgtttcagctgacattcaaaagcacattgtaattcaaatggaagtgcagaaatgcaatcccttggacagtctaggaaaatgataatagagataagacaccttttaaaagtggcgacatgtatttatctgtggggacatttctataccatggactctcccaatctaaactcaggagcagtgcaaacttcacatagagaatgtccttccacaggggtcacctaggcagtacacttggaaaagacatgttaattgcatagcattctttcacttctagcctctctttatctcgccatttctctttgtggattttggtgtgcctttgtctatctctctttgtttttctgtctcctcctcccctcccctcttttctctctctctctctctctgcctttcttttcctctctttcttgctctagctctctgtccctccctctctctcacacacacacacagaatgaacaattctttcacatacacacatctgtcaccttccatagtcagtttctctataaaaaagaagcaattaaaaattcaaaaaacttattatatttctaattcctgcatctatcactatcctccctaagtagagaatgacaggggatgataaaagttacagattccttttgatatctccccagtccagttccacagctctttcccttcactggctccaagcctgtagctaaactcactgaggcccctcccaatcccaggacaatctacctctgcccttgatcctgggtcacaacgatgacaagggatgagagcaaattagcaagccccacccctgcccacacacatgtgtgccttcacgcacatacatacacacaaacatacacacctgggaacacagtaatcgaagtggatgtggcagccttgggtggagggcatgggttggatcaagataattaggccctcaactcagagctggatgggtccatccattgctctattttcttattccatctatacaatgactttgcattttgcatatggaaaaactgatcttaaagaatgaatcactttgctcaagatcacacatctgggaagaggtagagctgggatttgaattgagatccatctgattgtaaaacctgtgctttatctccaaatgagaaagtctttatccaaggtagccacaggaagggtgactttatacagtgaaccctcatcatgatataaagctcatgtatcatgatcacagctagggagaatgcgtgaatatcaagtcaaagggtgaaatggagccccagtgggaagaaggtagttttttcaaaatacagggatatcaagagcacagaagcatgtaatgaaagtattatgctagaggaagagactcagaagttcacacactgcttgggggaatggcacgggagcagaggtgatggctaaagaaacctgacaggctaaacagcttccatgctaatcatgtctggaacctagagcttccagggatgactttggctgctctagttgtttcctaaggcccagttcttcctgcattagattctaccttattgacctgttcggtgttccagtcccctacggactactggaaagctcagaattcccacctggtgatataaaactctgccttcctgcctggagatcttaccagtggttattggcatgcccagtgccccctctggaatcaacatcaaaaactaggtctgttattctagcttttatttttgccctattacagggaagaaaatacagaggatctagaccactatacttcctttctgtgtctagaatagacattaccaactgatcatctcaatgatcccaataacttacacacagtgttctagacaagccattccctagttgatcagaattggcacatgaaagctagagagcataatatgatagtgactgggtattccaaccagcctggaaatgttggcctcctccctcttcccagctgtctaccagtggatttttaaaagtctgtaacaaaaatgatgaaatattgggatactaaggcatgctggtaatgaacaacgtaggaacagagcctatatcttctttatttggtgccacaacatctgacgcacacacaaaaaaaaatacagagaaaaagcagttgggaaatgttcagacaatcaatgaataactatgactttattttcccacacaatgtacctttagaaacacttaggggaatgagagtaaagtaaactcctcatgggaaatattttaatcaggcacattcaccccatctcccttggctttccagtaatttccagtggtttccccagatcataaaagtggccagggtcccatcattatgaaacctgggaaggctagggcatttgtttctaatatccagggacaccagagctagggtgaaggaagaactgggctgaagtttggattcaaataccatcttcttggccttttgcctctgtaagttaaggtttccctcctgtaatgggggaagtgagtacccttgcctcctttgctttctggggtagatgggaagatcacaggaaggccatctggaaactgtagagggctgtacaaatgctcatggttgttatccatgccctatttggtctattttccccaacctactctaccgagtttgaccctccactcctcccttcactaagagttaaaatgacacttacaggattgtctttatctagtgacatctgtaattcacagataaaaatgagggtagaggctgggcgctgtggcttacgcctgtaatctcagcactttgggaggctgagatgggcggatcatgaggtcaggagattgagactatcctggctaacacagtgaaaccccatctctactaaaaatagaaaaaattagccgggcatggtggcgggcgcctgtagtcccagctactccggggactgaggcaggagaatggcgtgaacccggaaagcagagctttcagtgagcagagatcgtgccactgagctccagcctgggtgacagactgagactccgtctcaaaaaaaaaaaatgagggttgacctcacacattagcaaggtatggagctgggactagaatcctcagccaatgcccacaatttttactttatttcaagctactgttttctatgtacctactatgtaccagacattttacctacatcatctcattttattctcccaaaagccatgcaagagaattactatccctcatttaacacatgaggaaactgagacttagaagttcctttacctgaggttacctgccaggtgtgtagaaagaggagtaaagacatgaaacaccctccatcccacttcagcactgcactatctctcctcctctcacaagttctgcccaccgagttatcagcctccaagcccagattcatcctggcctggtttccaacgtttagcagatggcagtgacacataactcatggccggggagaaaaggggatactagctatctttaagtccaaaggcttctttcaactctacagatgcatatccccagcttctcatctcccattccctagcatcactcccaaatataaaaaataaaaccggagtatttgatctaccatctaggtggtcacagcaggtgaagatggaggggaagaaacacacacagaatggttaagctgacctcaatgcatcctctgtccttttcttgggagcaagtatggacgatggaagcaagaaaagtgcctttgcagactagaagcccaggaaggaaaacaccaagtttaccccacaagtttgcggcaaagccaggtcttgagggggacccctccagctgttgtttcagcactctttcttcccctctcccatcttacttgtaacagattccatgatccaccatacaaggaatgggattttctggaatgagaaagtcaagtctaaagtctgaagacagctaaggatggagaaggggtgggatttagaatcagagtagtgtcccaagccccaaacgtggtatgaagcaaattagttatgtagccacagtgagtgaaggtttttataaacataacctaatagtattacttcaaagtcctgaagcttattgccctgcttaatgatgtgtcacattatttgtagggtagcacaatgagacttctattgatttaatgcacttccttaaagactgtcattgacacagccataaaacggagctattcccagacaactcaattatatccactgtgcccataaaccaccccgtgccccacacagttgcacacaggaagcagaaagggctgagagcacgactggggatgcaaagcccccagggacaaaagggaagggatctagagattgggaagcaggtggactagggttttatccagttgggaatgtgcagctgcataaaaagcactagacaggaggtgtagagcaccccacttggtcttggccctgccaagcaaagctgcgtgaaagctcccttcttctcccctatagacttagtttcctcgactgcaaaactggagtgctatgctcaatgagatccttcagatccctcctggctcccacattttgtggttttttgttatgattgcttttgttcttggagatagggtggctgagctgtatgaaaagatgcaagcatgtttttaacattgctcttcaccctttccatcaattgagagactttcttttacaaatagttgataataatagtattaactatatcaagaagcatttcagtatagttgaaagagggaaagaacatgggcttttgcagccagccagccttgggttccaatcctgaccctgctacttattagctgtgtgtctatgagtacttgatgtggcatatctgagactcattttctcatgtgtaaaatgggagtatgaatacactgacctattaaaacacatatatacacatgtgcgatattctaacttcctcaaaatgctattacataaaccacttatctttaatgtgagaagcagacaagaatagctacttacgtacccatttcacaggaagagaaaattgaggtggaaaaggaataaccttcacaaggtgagtgggcagagactggtctccagcacctggtctgaggaattccaattctgataatagctgagagtcagaggaaaatgaaatctgctggcccttcctgaggataaaagcctcaccacaggacagaatggaaaccgtctgcttggttatgaggtgattgtttttccaaaggaattgagttcttcttgggagagaagaacccaagatcttcttgggttctcccaagaagcctggagagaagaaagtgtcaagaagacaccacttgctgacccccaacctgatctctggcagttgtttcaaagagaggatgtgggaagcaaagtacctgcaagagaaggcaagggttctggagtctagaacactaacttgaggcctcagaaaatgcctgacttgagagaatcctgcaaaatcattatacgatccctcactctgcccatggtgaaactgaagctcagagagaggcagggacttgcccatggtcacacagcttagacgtggcagagccaggatttagatccaaggcagctcagttgtctccccagaccccttgcctctatagcctgcctggccacctcctacagtaggcactccgggcttacctttctgatactggagccacagctgctgctggaccttcttgctgggaaagtggatgatgcaggtgagctctgagccatagagggcctctgcgatgtagtgggagccatagtgctggatgaaggacagcagctcctcccgactgctctccttggtcaggatcttgagaacattagtgaagcctggacaagagaggagcatgtggaggtggtcagatgtgagaggctggcggctagcaaattatacggtggcaggagttcttcccaacctgtattttgtgccttacccctcagcacagtggcagcttggtggctgcactagtccaaacatatacataattccctcacttaaatagcaatgaatgccctctctgaggggtacatcagacacggtgaccaagagggaatctgcaggagaagaaggcctaaactcagcaacgtagaccatgggaacttaaaaaagataaatcaagaagtcaaagctgatatccactcactgagcaaccaatgtgtactgggaaaactgttagatgtttcaccctctttatgtaacttaaccttagccacaatcatatataatttgacaacaacaacacccattgtataatgagcaagtcaaagctgagagactaaaattgagttatcttgaacttccaggtagagaaagaagctggactcaaacccacttatgttctcactgcacactgcatgcattttccaccacaccaaacaaaccagggcttgaactgcccatggctggaatcctaaggctgcatttgcccagagtcagcatgtattctgagtccatgaatctgattcctggtttagcttcctgtagcattgcttttctttatatctctgctgttccctctctttaacagtggtatgttctctctccctagatttccacagagccttcttgctgctctatttcttagtcctaggctaagtcctcagcacttaacatggggcctgcacagcagtcactcagtaaaaactgctccctctttctctccttcctcaaacaggcacatgagcaagctattcttccagggacattcctgagctcctccctgctactggacaaagcctagtgaccttctttagaaattcaaggttccaagctcatctctaatgagccacccacactaagttttagctccagccaaattagttttattatttatcctgaatgtgacctgaaatttctatcattctatctttccttgcattctcactacactcaacacacacacacacacacacacacacacacacacacacacacctgaaatggcctccctatgtcctccctaagtcacacctatgcttcaaggcccctggaagtcacctcttctccaagaagcctttcacatcattatggacaggagtgcctactgtctgcactttcaacatgcaccaccttaaagtcggaagctctaccttatttgtctctatatccgcacatgcatcctccctgcacacccaccccaactgggtacatggcccagttcctgggacacagcaaacacaccaaccacaattattacaagaacagccaacactgtgccacatcaaagtaaaatgtaaaagaacaagcttctctccagcattaaaagtgagctccaatttgccaacatttgattgacaaaagggttttccgggagcatcattattgattaattaaagcagatgcacctttgtacttctaacaggaacatcatagtcttattcacaaatgcagtgtggggtgtggggggcagaaaacaaaaatagggggctcaaagaatgggtgtttgatgagaacaacccctctccatcaacctgttaagtaatacaactgggtaattaatacagtagtgttaataacgagatggtttctgttaagtaataaaaaacaataccacagagatgccctgagggtcttatccaggcagacaaaactgcaatcaaatccttgattcattcattccctgctctgccacttactagctgtgtgaccttgggcaagttatttaacctccctaaccctcagtatacttatctgaagaaaaatgggataaataatgtcttcctcacagtactgttctgtcataagaaatgaactattataaaatgcttaacagatgtcagcaataattactatttctacttcccagagggtgaaatcctccaattcccaggctgtaagagcttcattttgctgatgaacaaagaaaagagaacaaaagacctcatagataattagaggacactcagacaataaaccagtgaaagtgttattagtaagagttagggtagaatatcctaggtcaggcctcatctttccagattccttcattcattccttatttttcagtcttcatttatttttaaaaattcctccatcatacatgagcaccaacaacgtgctaatctttgttagttttggagatactggaataaataagacccaagccccgcccacagttctcaggtcatagacaagattccaatataaatcaaggacttgttaatgtcttgatatagatatttaagcaccgagaattccgtgagttgttttgaggggaatggagaacgggggaggcatcacagagtaatatagtatatgttcccaagacaaagaggtccaggcagagggaacggtatgggcaaagtcactgtggcatgagagaacatgcaccattttgggcactataaattgttgccatctgttggagcttaaagttcatgtggatataatgtgggtggtgcatgtaaagggatgggggtgtgggggttatataagatttttgtatcggagatggacaggaaaataaattagccaggagagaaagagaaattggtgtctgaggagaatttataattcacaagcttgaaatacttcaaaaacataaatatgacttagatactgtttatccctactctcctattcatccctccacaccctactcagataccttttcctccaggaagcctctctagctcccccagaatgattagctccatcttctgtgccaccgcttccccattattgcatcgaccctactgtctgtcagactcctgtccacccaccctccctaggactccttgatggcagagaggatgcatcctcatttcctcagcatccccagtgctctcatatgccctggcacatgctaggtccttggcaacaagtgctaaattattccaagtcccctggctgcccaggcagtggtcctcacctgctgcgagggtgatggtgctgagcttcacacggtagaggttgctccggacccgccactgctgcaccatggggtaacccatggcctcatcatacctgatatctcctgggagagaaaataagatggtcacgtgagcccagaattaagacgcttcacaccacattgttcaccctgcagctcttggctctgggaaacagacacctctttgaagtacaactttcactgggattgacaattttatgaaccccaccctccaggcctctttctggtctctaatctcagccctacccctcatttttctctctgctctatagcttgcaagtcccctttaccctacaagcaagagcaacctcaggtcagatctatgtcttacctaaccccatttgcaatttgccaccaggcactagacatcccagtgcttcagtttccacatctgacactgtagctctctctaatactcttatttcgtaggcatgttgtgaggctcaagtaaggtaccagaagtgggagccctctggtaacctagaaatgttgtgcatgtagaccacatgtaagtaaactacagcctatttgttatgtattttctgtagctgctttcacactatgacagcagagttgagcagttgcaatacaaaccacctgcaaaggctaatgcatttattaactttcccttcatgtttgctgacccctatgtagactatcatttcttaacatggaaacatggatgttcataagtattatgtaaaatatacgtatacagaaataaactctttctatttcaagtaagactgagaagcacaggcaaaacaaagtttaactgtataatttctcagcatcttgattatattaatatgcatgaaagtagtgtgcaaacttctttgaccataaaaccccttttgtatgaaaggtcctttggaattcatgttttatagaataaatttcaggaaacactggtgtaaacaagaaataaaaacagaaaagacacaacgaagtgttagcaaatgattaactttgggcggtggtaaatgaaaaattcttgttttctgacttatattcacatctattttctaaattttctaccctaagctttgcaaactctcttttttataagctgaacaaaaatacattaaaaagatgctagtcacatcagcagttattattactgtttttatgtatccacactttcttgtgcctctgcaaatggcaggcacattttctatccttttctcttgtcccctggtgagtaggcacttaaagagatatttgataccaagattaaaatgagaatctcattggaacaaatgatttcttcctggacattactgcagtattaaagttgtccattactgtcaactttttttttttcctccttatgctccttagccttttcaggaataaaatagttttttagaggctttcattttaaagtaaaatattcatgatccccaaagatatgtccactggagtgaggttgtttgttataaatacatcctctttgtttatctgctctgcctctcctggccttcctttgcagaggctagggagaaaaggagattgtgtggagggaggaagggagggctatgtttttgactaagggcagagaaaatgtctgcacaagaagattcagacaccagggacaaggcagtctctgctccttccattactgctcattcatgttcaaagcagacttgctgggggcattggcagccaaggcctatctccaacagaagaggcagaatgatgcaggctgttgagaggcagctctttcacttggtggcatgatgtccaaacataaaaacaaaacaaatttaaaaactccttctgattatcaagtaatttgtaaaaccatcttctcactccatccctcacttccttccatctctgctcattcctggattcatgcctgaaataaaagcttctccaatggaatggatgtcagctttttgaggtcaaggtcacggtctatattcctccccttctacagagcctagaagagagcctggcttatagtagcctctcaataaatgcctatccactggcggcctaactctcactctgttcctaaccataaactcatccctgggttactctatcgctgactctcatcttgccctccccatctcagctccccacctggggattatggttggaatgaagctatgtgatggagggaggaatttttcctggtaataataataataataataataataataataataataataataataaatcttttgaaatgcaacagttccctttattaggaaatctccaaggatccttgagtcaaaacaaagaatcataacaatttgaaccactaatggatacccatagtgtgccaagcattttatatacatgatctttatttctcattagaatcctaaaaaaaaattatcataccctatttttttgttattgtgttttgttttgttttgttttgtttttgagacagagtttcactcctgttgcccatgctggagtgcagtggcaagatctcggctcactgcaacctccacctcctgggttcaagtgattctcctgcctcggcctcttgagtagttggaattacaggcacccaccaccacccctggctaattttttgtatctttagtagagacggggtttcatcatgttggctaggctggtctcaaactcctgacctcaggtgatcaacctgcctcggactcccaaagtgtggggattacaggcatgagccactgcgcccggcccataccctatattttagaggaagaaactgaggctcagagagcaaaactgtccaaggacataccaggatcaatgacaggttcaggggcctttccattaaagcacagcacctcctcacagaccgtggacatgtctgctttaggaggtagtaaactccccatcactgggggtatccaaagagggataaccactcaggaaggatattatagacttgattcctcattaggagggaagattagactagacaccttttgcagtccatgttagctccgaaattttatgatcttaaaaaaaatgaaaattaaggaaggcatagaaatttttgtaacattttacaaggtgtcttttacatccatcatttcatttgatctacatctgggtccctctttgaaatagcacaggtcaggggtgatgtaagatagtggatatgccatcagctttggagtcaagaccgactttgtttaaatcttgacatgactatagactagccacgtggccttggattagttcatgtccttgctaacaagtttaaaggggacaataatggccttgcagggttacatggtttaacacacaaaaagtgcctggcccccaggaccccttaagcacatgtgggttctctcctccatctatgctcttttacaggaaaggctcacgggagttagatgactcttttgaggtttcccagagcttgcaagtgatggggaagtcagacagagatttcaacctaggtctgtgagattgtggggtcttccctggggaacaattcccctctcagtgaaagagctctattatccttccccatgacgattcccccgtgactattctccctgggcagtggataaggcacacaaccacagtatcacaaaggcagagtcgagaacctcacatcttaggaaatttcttaagaaaagggtaggagaggaactgggagcaaaaaaagaggaaagagcatcctggggttggacagaaaatatggagtctcaggaaagcctgcaaaaggcaacttcccagtggagagagaaagtggttgcaggggtgggggagcggcaaagtggagtagaaagggcaaaagacttggtgctacagcacccaggttttagtcctggcagatatgctgtgtaactttggactggtcccttctacctctctaagtatagcttcctaatctatcaaatggtaaaaataatacccaccccacagatggcacagtgcccacgtacaaaaacgagctgtgtaactcgagtgctttcaagtaggaggggctcctgattggagagtccacttcttttactttggaatgacttaaaacgaaccaagaaaacaaaatactaacagtggaaaaataccagaaaattgtcaatgagaatgaaaagtgttttgagactcattcacagaggcaaaactctcactgagaaaaatcgttcctgttctcacagaggaacctcctctcaaagatgactgcagtcccaagtctgaggtctcagggaagtccctggttctgctcagccaatagcaggagcccaagaaagggtaagttccttcccatacccttcctcatgaaggaggaggcttgacagagcccatcttggatctgctgaagactgatatgcactaggtgtggagactcggtgtgtggtcagggaacctgggaagggtctggcacatgtgtcttaccagtgagcagttggaggtctggaaggggctcggagaggaccccccggcactgctcctccaccggcagcgggatcaccaacagcccatcggccagctggggaaagtccttgatgaagttgttctccctgtggagaggagcagagagactgccaaatcgaggaagtggagactgctgaggactacagggcaaggaggcaggatgctgtagtcagaataaagactcatggtggggtgactttgctgtaatgcctctggtttcctgaatcccagctctgagaacatggtgctaactacaggttcctgaatcaggcaggctggggttcaaatttagccccactgcttacttggctgtatgatctcaagcatgctactgttcctctcagaacctcagtttccttgtctataaagtgagactcagatctaagggctgttgtaagcacttaatgggaaaaacctaccaattatttaagatactttctgatgctctataaactgtatgtggccgctaaatgtcccctggcataagcagtggcaatgttgaaccaggatgtgagaactgagaatagtgcgtagtgtttgcagaacaaggggcaagactaggctgaaaaaaagaaaaacaaacaaacaaaccttggaaaaaatagatgtttgttaaatggaagggccctaagagacttttttttttggctcaaacttttccttttacagatggggaaactgaggcctggagaaagggaatgacttgctgaatcacaacctgataggttagactcaaacccatgtcttctgactccaggttagtgctctttcccttgctctaacttctttaggtgcctctaaccctttcctgcaggccagtcccagggaacagaagacagacctctgaatgaccccagaaaactgaactgtgaacaaagttctgagaggatggtagtaacagtgcagcagagggaggcaggtttcattcttctagacaatagacctgcctaaaaattaacagcctgccaagagaggtggtgagcttcctgttactgagggtgtgcaagcagaaaacttggcagccagttggcacggatggtatcgaggtcttttccaaattaaatatgacttatgaggtccctttatattcagaaattcccagcattaaagacatgaattatagtctggagaggaggaggagagaagagaagggggaggagaagaacaaaaggaggaagatgtttattacttcattttgacacatggaatggtcaaccttgaaatgaaaatcagaagcacgaaaacaaaaatatgtgatgccaaagcaatgcctttgaagcctgtatctcagacagttcaaaagcagctgtaaaagtgttgagtggcttgggtcaccttcctgtctgctcaacatctctgcaccccactccaggcacctttgaagctcatcatcaattcatccatttaatgaacactttcttcatttctgagtccagaggatgtgacattatcaccatcttctataccaccagcatcaccatcattatcatcattgtctttgtcatctatattattcattgaatctttataatttgctaggatctagctaaatactttacatacattttatcacttaatcttcacagcaatcccaaaagatagatattattatctttaagttgcagacaagtagcatgagatttggtgttaacaggtggtggagctgggatacgaacccaggtctggttgggcctaagactgtctgcccaggcatgcacgtgcatgatggtgagttttaaggcccacacttgccatttaaacatgctgctgtgtgtgggtgtgccatggctgtctgtggagtcatccttgtttatgtctgtgtgtgcctgtgataatgggttctacctagatggttggtctttgtctacaaatctgggagtgtggaacagcaatatgaatttaaaaagacaggcttctggtagatggaagtaccaccacatagcatataaccctagccaggactaaatgtcctcatgcttcccttgtgaggtggcctctggtgatagatttttccctgaaagatgtagcaggatggaggggtagtccatgccctagtcattcaaccagcatgcactgagcacatacttgggtggaatcctgtgctgggtggtgctaagaacacagagacagattgatgtttccccttgtcctctagatcttctcagcctagtggggaaaacacaaaaaatggccatgcagaataatcagtgggggctgctatcaggaattctgcatgtgctgggtgctgctgcacaaggtctcttccctacaagatccccagcacttgttttcactctgggcaggagaggctaagggtgaggaggtagctcagccttggaagctgagaagagcctatgaggactgggctccagttctgcccacactgcatcctagctgtgtaacctggagcaaaccaaccaaatctcaaggttctgttctgtaaaatggggatcataacagctattcagctggccttagtggaatggctacaataacaatagccttttattgagcacctactatgcaccagacacaattggcagtacttattcttcacccaactctgtgaagtaggtgtcatttacattccccattcagacattgaaaagctgaagcacaaagaagttatgtaactacctaaagccacaaggctgggaagtgggagatcccaggtggtttggccccagatcaaaattgagtaatatattgctttcaaccatgagttaagttttaaagttgattcaatctgatatttaaattttccagaattctatgaggtttaaaagcaaactaaatgcttaagtatattttatactttattatgtactaaaaaatgaccagattgtggtgttatttctcagcttgcctttccctaagcattcactcagaaagttgaatatagaagggttaatatttattgtatgcctggcatagagtctttgtttgtctaacaggtcatggtagatgtcttcaaaagacatcctagcactcctcatcactgcttgggtagagggtgctaaaggacctgcctgtgacacacacagactgtcagtgttggaagggccatagtgcctgggcgtgtgctgagcccagacaggatgcagccaagaggaggaccttgctgctcctacaagagaggagagagttagctattcaccacatgccccaggctctgttctctatgtgacctcttcaagcctcacgcaaatgccacaaaataggcatatattcccagtttaaccgacaaggaaatggattttccatggacttacataatggatgcatttgggaaatgaaatctgaaggcaaatctatcatttttcactttaccacccaagagtgtccatttcaaatctctagaaatgttcttacaattgtagagaagggaaggtaatgccaccttctctatccgcatgtccctctcttccaatccttctgccttcttatcaagtcactcttagctctgcaaggaaatctgaccccaacgggacaatgcaaggaagtagagtgtgcaaactcaggaggcaggggcctggctcaggacaccccttctcggaggaaggttttccttcctgagcttccagaaagtagaggggggacttggagaaatgcagaaagacagagaagatggaagggtgacagttagccagccaatatggaagactgggaagaagggtggcaggtaggcggagatgaagcccgaatgaacagcccagcgacggcatggtctctcgggtactgggtccctttgcgaccgcctgggcgatggccacaagtcctgcaaggcctctgccagcagagggcgcccggggcctttgcatcgatcagctgtttcgggaggcaaaacatggatgagagagtagctgctgggaaagttccgctgggctgagaacctcagatggaagcctagacaacagctgcagaacccacccacctgggagaggcgaccagggagctggcagggtgctggcttaaactcgggtgctcaggaataattcagattcttagcgctcgtgtgtgtgtgtgtgaatgtgtgtgtgtgtgtgtgtgtgtgtgtgtagtaaaaactaccacacaactaattcgtataataggaagacagaaataatggacaatatttatttattgattatatctgttgctcatcagttatgctgtagctcatgtgccaacgtgtgtgtgtgtgtgtgtgtgtgtgtgtgtgtgtgtgtagtaaaagctgctaggtaactaaccctagcaataatgataatatttacagagatttattgattgcatttgttgaccatctcctatactcaaggtagtgtgtcaagatatagtagcgtacaggaatggaaaaccaaaggttgtatgttctcacttataactgtgaactaagctataaggatacaaaggcataagagtgatataatgagttttgaggacttggcgggggaaggttggaagaggagtgataaaagactacatattggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaagactacatattggggccaggagcagcggctcatgcctataatcccagcactttgggaggctgaggcagaaagatcccctgaggtcaggagttcaagaccaacttggccaacatggtgaaaccccatctctactaaaaatacacaaattagctgggcatggtggcacccacctgtaatcccagctactcgggaggctgaggcatgagaatcatttgaactcgggaggcggaggttgcagtgagctgagattgcgctgagactccatctcagaagaaaaaaaaaaaaagactatgtgttgggtacagtgtctactgttcagatgaagggtgccctaaaatctcagcaatcaccactaaagaacttatctatctaatcaaaaaccacttgtacccccaaaacgatggaaattaaaacagatataggagtgtgtatgccattttaacctcataagaactctgtgagacaggtactatcattattcccactttatagacaaagaaacatgttcagagaggttaaggaacttgtccaactgaggtccatggtttgaaagtggcagtggccaagaccgcattctaacccctagcttccagctgagagcccagcacgcagtaagtacatgctcagtgaatcgatcccaagcctgtgctcttgatccctggcatagcttgactcatttagagatgagaccaggcagttctgttattcaccaccacagtggagtctgctttcaagaaagcatttttgagagatgcttgtttaaacaaacagtggctctgctgctgcttgaaacacaacattcacttacacacacacacacacacacacaaacacacagataagcatctgccaaatttatctataaaaacagttcaatctcagtcgacattctagggaaacaattcatcgattctaaaatagtagatcttgggccccggggactctggcagtgagaggtctccttcatttcacaaacacttattggagctctaacctttttcaggaactgttttgggtactagggatacagcagtggaaaatcagaggagatgcctccattcatgaagaccaggagagaatcaatgttgcattgaggtctacaagatccctcattatctagaccctgcctacttactcctgctgccttattgtttgagccacagccccctgggccactgttttcctcctgctctgactgtccttaagttccttttctggggcatgctcccatcctacacaaggacccacttagaatttgccctctctctggaatttgccctccctctggaatttgccctccctctgcacctgaacaactcctactcatcattcagaccatccactattcctctgcctttgagaactctcgctggaatcagttcttccattacacacccttatagtatcttgttgttttccactatgaagggctttatcgtttctaacgatacatgtgctcatggaagaccttgttggacacctgtctttcccactagactgtgagttccatgcagccccaaactatgcctgtccaatgtactgctgcctcctcagggcccagcagtgcaaactgagtgcctgagtaaaactgagaaaaagtaggtgcaccatgagcatttgttgaagcagtgaaggaagaaaacccagagacaatggtaatgtgtgcatgaccacatctattatgaagccctttctgatgttttgccagagtctcagaatgcttcaggatctaaagcatattgaggatttgagtctaatattccataagaagcttcaaaaccctactttcttaccctaaattcctgagtgcatacatactctggctcccatggagcttggacagaggggccaggggccactgagtgagtgggaccagatgagaaaagatgatctccctaagaaaggggttggttaaacctcccattcttggtgtgcatatgtgcattcaggtagaggtagtggtgtgggcacattctaaaatgaacaatgccagtgggcagcaaaaggccccattcaaaaaccatcatttccataataccattccagttttccccagttgaaatacatcttttctatcactttaatttcatgcatcttctttgtagattccagatgtggccttgggatctagtgatagaaagagcatgggcttagaactcatacgcacatggatacaaattctagctgtgtgaccttcaggagtatcacttcaaattttatgatccttagtgacttcatctgtaacatggggataatgagttcagcttcaatgcgtgaagaggaggatttatgtaaagttattttattttatttatttatttttttgagatggagtcttgctctgtcgcccaggctggagtgcagttgtgcgatcttggctcactgcaagctccgcctcccgggttcacgccattctcctgcctcagcctcccgagtagctgggactacaggcgcccaccaccacgctctgctaattttttaattttttttagtagagatggggtttcactgtgttagccaggatggtctctatctcctgacctcgggatctgcccgtgtcagcctctcaaagtgctgggattacaggcgtgaaccaccgcgcccggcggtaaagttatttttaatgctagcttattttcctgaatcccatactagattctgaatctctccaaggatctcagagggcccagcacagtgcctttctcactgtatatgcccctgagcatttgttgaaccatgtgtaatagaaggggaaggtctctttaccctcccaggctacctgcatatgacctctaaatgacagaaatcctacaaagcatttccactgagatgcactgtgtctagcttccttctgatcagccatgctgacagcaaagacaaacaagggaagctggactcctctgccactctgtcctacccttcctcaggtctttgctgcctgccgcccccttttaagaatatgtgtgttttgggtacattaatacacagcagccagcatgcaagagccatcacccctcagttctagggaaattagcatttaaattgaggtattccaggaaggtaaatcaccttagagccagccagcactgtctgcagtcttttcttacttgagggaaagctaggagccttggcttgggagctattgagtttgcagggaggggcttgctctccttgcctggttctctggctcttcctacactgcccataagcctcaaaaaaggttgccttaaaatcccaaagctgatgaggacatattccctggtgtacactgtgcctcatcccccctctctgactgaactgagcctttatgccaagtgacaggatgactttggctgagatttggtgtcctctgacaacaagcagttgggagacctgtgttctcatcttggctctgtcactggctggctgtgtgatgtgcagaagccactgtccttctctggaactgagaagaatgggctggtacaaaacgtttgtctgaacctcaagctgggaggtgctgggctagattttgtagctgtcctgcaggtgccggagacatctatagggtctggtggtgataaattgatgctaacactggttggttggtaccagcccaccctgaagctctgccctcttaagcagcagttagaaactgttctcatatgctctacttcttaattatgcatcatagtttaagttctctggtcaagcactcaatatttagtgattccttcatttaaccattcattcgttcattcattcattccttcattcattcaacaaatatttactgttatttgtcaggcattaggaatacaacaataaaaatgacaatctctgtcctccagttactcacaggctgataggagacgcacatgtgtacaaatgccttctatgtatgtgtgcacatgtgtgcaaggtaaatcattgttttgaaaatgttaaaatgtttttcattctccggaaatcctatttcagctttgcctctcaaagttgactttgcagtgtttcaagctggacaatagtttcaaaacccagcctgtgctgagggcgaagttcccttctctatcaaaagacagacctgctgactcagatcattatgttttattttaatatacagattgggcaggtgatggcctcacagttgtacccaccagataagaaaaggaaatagtacactcttctttctgccactgatgctgcaaggaattgttgaagaggaaagtcaagtggctgagagttcagatgggagtgcctcagtgaccctcctcctggccttttggaagtcaaaccacccctcattcattccaagtacaagggtagtgtcaataaatgcttaagatatttaagaatctcgatacgggtgagcaggggtgatagggtttgctcccctagactcaggatatagtctgggaagtttgcaagcccctcgctcaacaagccaacaggagctcctgggagagggtagcagtaagtgaagaagagacttgaatttggagccacccatgccaagttctgcatacacagggtaaaggggataaaactgtcaagacttcctggccccataaatatgtgcaattgttatatgtcaattaaaatataaaattaaaaataaaaagacttcttggcataactccttcgctcccatggtggcagggatggtagatgaggctgagattagaacattagaaccaagggggcttcagagtgttgagacctaatgaccttggacattggctgtgtgttccaacacattgcttctctcaaaaaactacccaagaccatccatacctcaatggatgccagtgccagcgctcagagccaagctcaaacaaaaaatcacatagcaaataccagcaaggatccacaagaacacatttgtaccagagaccttccctcaccaacctctgccttctctgaggccaagttaaggggtaggggagactgtttggtaagggggagaggcaaggctggtggggagaatgcaactgaggcaagactggtggggagttgaactttgagtggactaaacgtttaccctagagaaaatgttttgtatccttaatcaaaaaatggaaatacttggccgggcatggtggcttatgcctgtaatcccagcactttgggaggccgaggcaggcagatcttgaggtcaggagattgagaccatcctcgctaacatggtgaaaccccgcctctactaaaaatgcaaaaaaattagccaggcgtggtggcggacgcctgtagtccacgctactcaggaggctgaggctgaggcaggagaatggcgtgaacccaggaggcagagcttgtagtgagccgagatcatgccgctgcactccagtgagacgggatctcactctgtcgcccaggctggagtgcactggtgtgatctcggctcactgaaacctccatctcccgggttcaagcgattcgcctgcctcccgagtagctgggattacaggggtgtgccaccccaccgagctaattgtatttttagtagagacggggtttcaccatgtcagccaggctggtcttgaacccctgacctcaaataatatgcccacttcgccctcccaaagtgctgggatttcaggcgtgagccaccgtaccaggcagaaacatgtttttgctatcagtggaatgaaaacttgagagaattattatgtcagttgtagaaaattaagacaacagtgtttttgtatactgagttgcagcaaaataatttttgaatgcttgactgtgagaatggatggttataggttagagggataaagtctaagtttcatcgggaaagttcagggacaaaggaaatgaagagaaggaaaacttaatgtagactgaggaggtcaggaaggctccctggaggaggtgagacttgacagattgggaggggttaacaagggagagggcagaaaaaggaggtgagggtggggcctaggcagaaagaacagcatgcacaaaagtccataggggtgtatgtgtgtgggcgcatgtgtgtgtatggaagaggcacagataaaacacatggcatgttctggaaattgcaataagctaagtttcaagatgctaaagcagcgagtgagaagcaaggatgggatagggctagaggaggccacatagggatcagatctcatgggttttctaagtgatgctacagaaggtgggcttcattctaagggtaaggagacccactgtagggtattcagcaggaaagcaaaaccatcagataggagcttcaaaaagactgcctgactacagggtagaggatggactgaaaaaaggctggaaggagggagaccagttaagaggttttgcagtaatccagacaagacataaccgattagatggacaacagaatacagagaagaggcacagatttgagagagagtcaggaagtagaacctgctgatctccattgccaactgcacgtggtggggagtaaaagaagagtcatgggatatattgagcaggtttgagcccaagcagtcaagcccatgctcctgtgctgactccagagacctgcctccccagtatttgcttattattagtactaataaccagagccctccacacatgcctgagttcattaaccacagctagaaaacagaccaatgtgctttgtcccatcacatatgtcctcggcctcctttctgcctctgctagctgtcagtccacctcagcttaactgctaactgtgagacccacaggaagatggccagatctcaagcctaacccccagcacttcaagcaggccaagtcaccacccagacggaggctctcagaactgcaatttgctccctagcagaatgcagcttgtgacccctactgtccagggtgtttcaaggaccatggctgcaaagttgctttactggcctatccagtggcccatacccatgggtccactctaatcacatctgatgctcctagaaatgataagcattactgttaccatttgataggaaaagaagcagaggcagtatagagaagtgtcttatttaaggccttgcaggtgttttcttggcagaattggactgactaccaatccctattcttagtttccaatccagtcctgtttcgacttgtgcattctcaagggttaggcagagtgacctctctacctgcctgataccttctctgaactgtgaactccttccaggcagcagctgtatttgtttcttctttgcagcctcctctgcgctctctcgtagacttcccagacagacctcgtggtgtcgtctccttcaggaagctgtcactgagtcccttctttggaagcaatatccttctgtttccacagcacttgactttggctctgatctcaagatcaccaactctgctaggtatgattgttctctgcacgtgtttcccatctcagattcaatggtcaatgctgcaaggatctatataactagtttccctcagagccctcctccccacagtctgattccagggtttggtatagacacagtccctaatagctgttcttgaggccatcatcccctctcatagcgactactacaatgacctgttaactatgctttctgaattcagccttgccccttccaattcatttactatcttgcagccagaacgattttctgaaatgtttctaacacaaatatgtcattagctccatgtattagcattctattgcagctgtaaaacatcatcacaaagttagaggctcaaaacaacattaatttattttatagttctctaggtcagaagtctgacatgggattctgggctaacatctaggtgtcagcagagatgtttctttctggaggttctaggggagagttgacttccttgcctttcccctgcttcttaaggctgtccatatggctcatggcccctttcctcaatcctgaaagccagccaaggcaaactgagtactttttttttttttttttttttgagacagagtcttgctctgtcacccaggctggagtgtagtggcgccatctcagctcactgcaacttccgactcctggattcaagcgattctcctgcctcaccctcctgagtagctgggattacaggcatgcatcaccatgcccggctaatgtttgtatttttcagtagagatggggtttcactgtgttggtcaggctggtctcaaactcctgatctcgtgatctgcctgtctcagcctcctaaaatgttgggattacaggcttgagccaccatgcccggccaattgagtccttttcacatcacacactcttacttcatcctatcctctgcctccctcttcctctttaaagatccttttggtttcactggggcctcctggttaatccagagactctcttcatctcaagatgagctgattggcaaccctattccacctgcactctgaatgttttcttttctatgtaagataactgataacttattcatgggttccagggattgagacatggacatcttgcattattctgccttcacattctaggtttttttcttttattttcagttttctttttccctaggaggactttgtcaatgcccctcttttcatttgggagttagatgttccttctttgtgtttgtgcagcccctgttctgctgctatgctagcattatcacactggactgttgttcccagtcaccctctgtctccctcattggaccatgagcactcgagagcaagaactacgtctgtcttattcactgctgtgcacccagccctaacgcagtgtctgatgcatgcactaggggctcaagaagtgcttattcaataaattgctgaatgtctcttagctgaatggcaatgtaggggagacaatccattcagctgtggtaccgcgatctccctcccatggggcctagtcactgccttattcatctctgcctcccttgccgtccttccttcacttccctagatatctagcacacagaataacaagtatcatttttaaagctaatatctattcatcgtttacgacgtgctagacattattctaagggctttgcatatacaatctcatttcacatgcacaacaaccatgcaaggtaagcactcttgttctacttttatagtgagggagcagagacataaaagaggaaaaatgcacagaacttataaggtgaggtttgaataatctaacttcatgttcttaaacactatgcaaaaatatgctggtgaatgtttaatttttccccaaatgaaatcctgaaaagtaaaggttgacttgttgcaaatgccgatgctggttgaatgtcttagatggatgccctttgttaaacgtatatcatgtgttaggttctctgcaggctttgtttccaaccctctcaacaaccttgtgagttaggtattattatctccctgccagaggtgggggaactggggctcagaggggtgagaatcactttcctggagtcatgtacaattgaatcagggccatctgcctccactctaccacctatctctccaaccatagtcacacttgtcttcttccctctttactgcccaccctcatttatacacaggtgtgcatgagcacacacacacacacacacacacacacacacacacaccacctacccccatacatacacagagtcagagtgaagcctgggttacacaaagcacatgtcttccctctctaaatgcaaaacaatttccaccagtggcaccaaactcacttaagcattccaggcatggctgttactaactcctgccctggtaattgcgatccctgaaattgaaagaaattgcaggctagaggaacattatcttctccttggccacttcgccctccatctcctttgcctgtgtgtattagcactgggatcccttgtcctgtcataacactgagaacaagctgagctgctgtcaccagggcctcttccagaactttcccctccactactcaaggaagacagtgaaaggccctcacaccttgacataaaatttagagatgtggctggagaaaagtcaacattactaggcatttttctgacaaagtattatcattatatctgttttccagatgctataaatgagattcagagaggaagattagccctgccccagaagctaaacacaaattgaaacctaaagatggcctccttaacagatctgcagggccagagtgaataattccctggttaaaagtggcagctgagctccttgatgagggggcacctcttagtccaaccctcctgctccagctccagccttaatcccaggactgcaggatgcagactgcctccctcaatccccgaggggtctagctgcttactttatcacagccaagggcagaagcccatatccctgtaactttcagtatgtttccagttcaattaggatcttcatattccagtattcagagtattttctaatcttaggaatcctctatctcacaccaacatttcactacacactcctcaagggcaaggcctggactccattcataccattggtatctcatgggtctagaataagagcagacacacagtaggtacacaaaaaacacttgccagatgagtccaagggtgaaggcgactgactctccctgaatcctagtgcatgttatcattccttatgcacccagtcctgccctggacagggagccaggatgtccaagttttacgaagctgtgccaataacttgctgtgtgatcttgagcaagtcatttcccatctctagggagtgtttaagtcctgaggtcatttatttgaataatgcaagtgtccccaaatggctccagtatgaagggctaagagaaagttctcaagatgagaagacctattctcatggacaccttatgtcttctctctcacctttttggaagtagtctttgcagtcacacacctggatttgcatcctggtccgccccccgtcccctgtgtagatctagttggacaaaacattgaacctttcctggacctttgtttcctcatcagaaaaatggaaataataatcatccttgcctcacatacttgctgtaaagatgaaaagagcccataaaatgaattgcttagcagaagacctgaaaatagcaggctctcaataaatggcagctattgctgctgtaaaatgcaccactctagcacattttaatttaacacactcaaaaagcttgttgtgattaggcataagaaggatgcaaatggacctgaaacccttttcttctcctcctgccctgacagcatgcacaatttgtccaagccacatgagagagctataatgagaatactggacatatggtcactaatttggggttattttctttacgtcatgggaatccttcccgcccgccactggtaaatttgattctttcctaactacagaacttacccacaacctctggtggagttggtaaagctaaaagcaatgctcccagcaccataagttgaatatctctcttcctatcacagcatgcactgaaattgccatggtgtgtctatttccctacttttggggggcaggaactaactgatatggtttggatgtttatcccctccaaatcccatgtggaaacataatccccagtgttggaggtggagcctgttggaggtgattggatcatgggggtggatccccatggatggtttaacaccatcccgttggtgacaagtgagttctctttcagttagttcacacaaaacctggttgtttaagcgagtgtggcacctccccttctctctcttgctctcactctcattatgtgatatgcccagctccccctaccttccaacatacttgtaagcttcctgaggcccttcccaaaagcagatgctggagccatgtttgtacagcctgcagaaccatgagctaattattcctcctttctttagaaattacccaacctcaggcatttccttatagcaatgcaaatagtctaacacactaactgtgttttctctctccttctgcagctcctaacaaagtactgggtgcatacttgatatccaattcgaaaatgtttgtagatgagccttcagtagactggacagcaaattaaagaaaaataacgtttaaaaactcttaaagcaaaagatagaaaataatcaaagccacattttaactgacgacacagcatcaattcatttgttacttcattccttgtagtagttagaaataaagaacttttttgaatgttaacatttaaaaccaagccataacatggactttggaatcagaacatatggcataaatacagctggttctggtgtgaatttgtggttggggtcgcatttctgaaagtttcttcttcccttttgtctttcccactctccctggggcaccttagaagtctttccatatagccacctctaatgagctttgcaaaatgagaaacctgctacagtagaagaaaatctaatagcaattgtttccttgttcactctctctctctctctttcttctctttccctctctcttttattagtcattagcaatggagaaagaaaacacccaaaggcagtagaaagacagtaatattcgcacgtgctttctgcaacactgcactaatgaggagccctgaccatcttgcatattccttcttattcaattccaacagtcctgtcataagttggagccacaagcagaacctagctagtgtggacattagccagtttgcttcataacaaaggtgaagtgtacatgctgttacaggacagctggaaattattgttaagtgctccttaacaccaagggatatcaagactttaaaagggcctagaaaaatacaaatccaattaatgaacagaatttttgttcttttcaaaatttgacatagaaatgtaattgaatccagtttgtaagaccctggatccagcttcccaccttcttagatactggttatgttgccatatgcaatcatacagtcatgctgagcctcaggtttgtctataataccctactccactcatagagagagggccttaaaccatacctcttactagatgtgctatcctaagcaggctgttaaatttcaggagcctcagttacttcactcataaaatgaggaccgtaatagtacctacttttataaattcaattatgaggattaaaagagactatgcatatagatagcctgtgtgcttcatggggtggtaaaaggaacaataactataaacagcctatgtatatatttgcctgtgtggtagttactgttactgtggttatttatttcctagtaagaagttcagagttaaagttctgcttccactcttgcaagtttggacaagttagcgtttcttactaagtttcagtctcctgatatgtaatggggacaaaataacagtaccagtgttgctgaattgttgtggaattaacaagataatgcatgcagcatggcacctgacacattatactgtgtgctccataaatgttaactattattattgttattattattattattagaaatgtgatttagggtttaaaaaataatatgcagcagaaaatcccagagaatccacaacaaaatactgctggaattaataagtgattatgacaagcttgtaggatacagatttacatacaaaagtctattgctttcccatatgctggcagtaatcaattataatttgaaattaaaaacaaaacatcatttacattagtaccaaaaaataaaatacttgggtataaatctaacaaaatacatagaagatctatataaggaagactacaaaactctgatgaaggaaataaaagatcaaaataaataaaaggagattccctgttcatcttcaatattgttaatatgtcagttctttccaacttgatctatagattcagtgcaatctctatcaaaatcctagtaagttattttgtaggcttggcaaactgattttaaagtttatttgaaaaggcaaaagacccagaatagtcaagacaatattgaagaagtaaaacaaagtcagaggactgacactacctgactttaagacttactataaagctagagtaatcaagacagcgtgatactggtgaaatgacagaaaaagagatccatggaacagaataggaagcacataaatagacccacgcaaatctagtcaactgatctttaacgcagaagcaaaggcagttcagtggagaaaaggtagtctttttgacaaatggtgctgaaacaaatagacatccatgtgccaagtaaaaagaagggatgaagaaaagaagaagaaaaacagacaaaaatctagatatagattctacacttttccaaaaataaaaataactcaaaattattgtaagtctaaatgtaaaaacctacaaaacttctaggagataatataggagaaaaattttagtaaccttggatttgattatgtgtttttagatacaacaccaaatatatgatccatgagaaaaaattgttgttggactttattaaaatgaaaactgctgctctgtgaaagatactgttaagagaatgaaaagacacgctatagactgggaatatttacaaaacatacatctgctaaaggatatccaaaatatacaaagaatacttaaaattcaacaagaaaacaaacagtaccattaaaaatgagcaaaagagctgaacagacacctcaccaaagaaaatatacagatggcaaatgagcatatgaatgtacacacatcatcccatgtcattctggaattgcaaattaaatgacaatgaaacaccactatataactattggaatagctaaaatccaaaacattaacaacaacaaatgctggcaaagatgtggagaaacagaaagagttaattgctggtgggaatgcaaaatggtacagccactttggagaatcgtttggcagtttcttaaaaagctaaacagtcttaccacgaaattctgcaattgcatgcattccttaatatttacccaaatgagtgtaaaacatgtccacacaaaactctgcacatgtttatgtgatcgtattcatacttgccaaaacttggaagcaacctagatgtcttttaataggtggttcaataaacaaacatccatataatgaaatatcattccacaattttaaaaaatgagctatctagccacaagaagacatggaggaatcttaaatccacattgctacaggaaaggagccagtctaaaagggcttcatactgcatggttccaactacataacactgtggaaaaggcaaagctatagagacagtgaaaagatcagtggttgccaggagttcagggagagaggcagagagaggaacaagtggagcacaggggatttttagggcagtgaaagtattctgtatattctgtatgatactatcatggtggttacatgatattatgcatttgttcaaacccatagaactatacaacaccaaaaggtaaattggggacgttagcaactaatattcaatcaatattggctcatcaatggaatacatttcacaacactaatgcatggtgaataataagaggagaaactgaaaggaaaagtggagataatatatgagagctctgtacttcctgcttaatttttctataaacataaaactgccttaaaaataaaatctattaacttaataatagcatgcatagtctaggtattttttgtagtcaattctattgttacaaagtgggagtggacaaactatacatctctaggcaatctgatgtccaccttttttttttattattatactttaagttctggggtatgtgtgcagaacgtgcaggtttgttacatacgtatacatgtgccataggggtttgctgcacccatcaacctcaacacgtcacctacattacatatttctcctaactctaaccctccccgagccccacaccttgcaacaggccctgctgtgtgatgcccgctgcccccacccccgcccctgctgcgtccatgtgttctcattgttcacctcccacttataagtgagaacacgcggtgtttggttttctgttcttgtgttaatttgccgagaataatggtttccagcttcatccgtgtccctgcaaaggacataactcatctttttttatggctgcatagtattccatggtgtatatgtgccacattttctttttccagtctatcattgatgggcatttgggttggttccaagtctttgctattgtgaatagtgccgccataaacatacgtgtgcatgtgtctttatagtagaatgatttataatcctttgggtatatacccagtaatgggattgctgggtcaaatggtatttctagttctagattgttgaggaatcgccacactgtcttccacaatggttgaactaatttacactcacaccaacagtgtaaaagcattcttatttctccacatcctctccagcatctgctgtttcctgtctttttaatgattgccattctaactggtgtgatgtccacctatttttgtaaataatgttatattggaatacagccacatccatttgtttttgcattgtttatggttccttgggtattacactggcagagttgagtagttgtgggagagcccacgtgtcctagagtttaaagtgttactattcggccttttacagaaaaagtttggcaatccctgttgtatagactctcaagctgaaaagtgtgtttaggagctgtttagttcaattacctaaaaaaaataaaataaaaatgctggaatcctcgcaaccacataattctgggaggaacaattttatagtctaacctctccaacaagtgtgaactttgacacaataatctcaagattattgtaggagaaatcaacttctcttcccttgctattcctgtaacccaccaggcccacaccttctgatctagaaatagcatgtcagagtagaacctggacacggactcatcacttacagccttcattctgaaccagttttgtcactcaaacccaccctgcttctgaacttcttggtactgactttctgctcatgcccctgccaccaactccggcttctaatttttagtttcaataccagatctgggtgccccagctatggcctaagctcctttggatccatttaaatgaaaaatacaatgataggctaaataatgaccttgaaagatattcaggttctaattcctggaaactgtgaatgacaccttatgttatgggctgaattataccccctcccctgcaaaaagaaaatcctcatatgaaattttcagagtcactccctccctgagaatcgcagaatgtgtctgtattcagacatagggcccttaaagaggtaactgagttaaaatgaggtcattaagatgggtcctaatccaatctgactggtgtccttttaagaagaggaaaactggacacattgacagcaggaatgtgcacagacagaggaaagaccaggtgatcacacagagaaaaggcagccatctgcaagccaaggagtgaggcctcggaagaaaccagccccgctaatgtcttgatcttggacttttagcctccaaaactatgaaaaataaatttcttttgcttaacccatccagttggtggcattttgttgtgacagccctagcaagctaatgtatcttatgtggcaaaagggactttgcagaggaacactctactagtctaactttccatctgcattaaatcaaaggtttaaaaatggggagagtatctggattatctgggttggccctaagcgccatcatgtatatccctgtaagtgggaaacagaggaatatctgagtacggaagaggcagaaggtgatgtaaacatggaaggagagactggaatgatgtggccacaagccaaggaatgctgacagctgagtgagacaagtaatggcttttctctgggagcctccagaagaaagccctcctaacaccttgatggtgaccctacaagactcaatttggttgttgcctccagaactgtgagtgaatacatgtgtgttcttttaatcactaagtctgtggtaatttgttacagtagccatgtaaaactaatggatgtgctttttcagataaatattgtttggggcttagtttgatttccaggccctcctcgtccacagccacccaacttttaagcaggcatcagacagccacttaatcactgttctgtccaaatgagagtagcatgcttatttaagctacatttctaggaactccgcagagaacaagctctaggggctcaaacttagtcttaacagatgccagagctcatggtctcaggcctattatagaacctatctaaacctcaatttcctaatcagtaaatgtggatcaaattatcaaccttctaaggttgttgtgacaattttaaatgatataagtaacacaaagaacacattttctggaatacagttattaacattctcaataagtaatattaatgatttctgtcattaattgtttgtggctctccagtaattccaagtctaacagatttccatttcccaaagccacagagagaatttgcaaacccatggcttggggcttagctctggcacctattcagtgaatttgtaccaataaatgtttattctaaaccctacccccaactcccttccactagtcagccttcttctatcagcagctggaaagttagctcaattcggcctccatccctgttacttccctctctcattctttgttatctccagttatctataagatgctccgaataaaacacacacacacacacacacacacacacatacacacacacttggtcatcggtgacttcaattctgctattttgcactaaaggaaactgagtggcttaaattcagaaaggcaaagtgatgtacccaaggtcacagagccaataagtgacaactttgtgaggtttccagggtgctattatgccacactgtgtctcacttgctgggcctgtctctccaaatcctccaccctgaaatagagtgcttccgcctacagctcctgctgaaatgggaaaagtgtttcctgtccacaggccagtcccctctccttccctttttttgaggactcctttcctcagggcagctcctagtgaggaaacagataagaggactccaagcaggtggtgcgaagttgtgagtcgccatgcccttgtgttggagaatgtggcaacacacctaatagtcctccctccctgcaggaaaccaggaaaccagcacttacccggagtgccttcctgctctgtcagcaatccagaccatatggttaattagctaaaatttgcgactgcatctgtgaagctatttttctttttggcatgcgtgaacttaattaccgaagacatgagaagttcctggcccactgggatcacggtgggcatgggtgtcacagaacatgcccatggctcagggtgtgagatatgtgggtggttgagagtttgagaaatgaaggatagagagagttgcttgaccagaggaggatggggtctttcttctggtgttcatgcagacatattagtaaagaatttcatggtgagacacaatgtcacaaggacccccatctgtgtatgtggacaagcatcctcaaaaaatggccaacccccttgcatggtagaatgtagggctcatcgtcttattaccccactgccctgcaaattctatcattagttgctccacagaatatttatcttcccagaacatatgactgtctcccccgcacataggacagggcctgtaacatagaaggtgtccagtaaagatggctgattggcccagtggatgagaccaatcatcttctgagccttcagtttctcatcggcagaaggaagatcataaaaaagttatatgcttaacaaattcttaatttgttaagaattaaatgagatatagtacatagaacacctatcacaggccctgatataatgacaggtgtttgataagaatttgttgaatgaatgaatgaatgaatgagcagccaattcaaacagaaactgaatgccattactagaagaagcctgagagatcaaaatctagtccagtccctccactgtgcctcagtttcctcccctgtaaaatgaggccaataaaatcacttctttattggattgtttgggaatcaaaatagcatgtagaacttttagaagagtgcctggaatgtagtaagaagtcaattaatattgctgctattgttgttgtgaataatagaaaatgggaaaacttattgctagcaaagaaaaaggcctcgcacaaagaatagcagtttgtggtgtgtcctgcattgtaacttggagctccttctttcagttcatactgctacttcctgagcagtatgggcttgccatgccaggagagtgccagggctcacaggacagacatgtgccagctttcaggggtcactggtatgacagaggagacaaattcccctttccctctttggaggacacccaggctaagaagtaaggtccagggttattttggacattattgacagaagaaacttatctatcaggagctctctgatgctcccaaacatagttttgcagattgtgccacagctgagagggcaaatggagactgaaattcatccctgttctgcaagccaagcttagtgcgtatgcagggatgtgtctccttttttcaattcacacataggcactgtattggcagctgtggcctcggagctttctctgggatcaatggacagcttgagggcaggagaacttgaagcccaagaacactggggcaggtgtttcatgggaccagggccattgtctctcatactcatctctgtattcccagggctgcctagtatagtgcttggcttagtggacacaaacacatgttggataaataagccactgtgttccttttattttattttttcttttaaagacaaagtcttgctctgtcacccaggctggagcacagtggtgctatcatggctcactgtaacctcaaacttctgggcccaagcattcctcctgcttgggactacagaagcgtaccgccatgccctgctaattttttaattcctttgtagagacaaggtctccacatgttgcccaggctggtctctaactccctgggctctagctgtcatccccacttcagcctctcagagggctaagattctaggcctgagccaccatggttggcccatggcattcttaatatctatcatagactctaccacttggtatgggcccagtttgtgctggataaatggatgactgaagcattcagaagaaaagtatgtgtgagaaatgatttcctagacctttagccctatagagtaaaagcaaataatttattgaggggcactgagctgtaaacattttctaccttaagtctcaaaacatacataaccgattgttcgcaatttacctatgagggctctgagatttgcctgtggtcatacagctcctaaggagcaataacaatatcagaacctgtgttttgctgctaccagtgcctgttttcacaaccatgctcttctcttctgggtcactgacttggctagtgagaaatataacattccctctgtctgctatactatttctttctgcttgtatactgatgacgcttttacttcattcatgcctctgcttaattgtcacctcctccaagaagcctgacgtgatcactgtgtataaagcaaaactttccaattccttatccttctttatttttctttatatcacttataaccactggaaatacatgtttattttctctctgctgctgccccatccccatctcttcccagaatgttatttccatgagggcaaggaccttaatctctcttgctaactgctattttaccaacatccagaatagtacctgacacataaacctgctcagcacgtatttatgaaatgactgagaggatgactgaaaaaccctgggtcagatagttaaatatccgtttaatgtcagatatgatctttctcttgcaggaccctggtttctttatcagtcagaaaagatacgaagtgccagacctgaggcttccctgtaaatacgggaagggctaacaggacgggtttaggagcttaccaaaaaaataagatatcattattatcattgcaaagcacatgtgcacatactccatggacacagatctttcatcctctccaggtagaacatcccaggtgactgccaaaacttccctgggctgggatgcacaggctagcctcaaagtgccagcttttgccacacccaggagaaaggcctccactaagccaaatcagtgtctcagtgttaagactattttttgaacagagaagtatggggcagcatttgtggcaccaacacttggtggccacataatattgggtgagtcacttgcacaaaaccaaagtaatgataacacccatctttgagggcacttgctagaatcaaatgaactgatcattttacaaacactttctgacatacaaagcttaacactgatgtaagaccctaaccttagacgtgaaagccaggctgagcaattcagacctgactgtgacttgggaacaatgggaggattccgagcgaggaacagacacattaaggcatatctttgggaagcaaacctggtagtgtgtgcaggctgggcctctgctgttggttcctttttttccttctagattgtgcctggggaagggggaggggagagaggtagaatctgcagtgtgggaaatcccactttgactctaccacttgcagaagggagtgggggtggcagggaacagacttgggtgacaggcaccacttgtgccaccctgattaactgggaaaatgcaaatctgcacttccttccccgccgcagctaacaagataatgaatattttcatcagctgcagagaatacaaacatctgtaggaacaccaaacctactctcaagggttgggggaggaggggaggacgcggaggtggggaaacgcagcttctctgcagatttagggaagaggaaatgtgctgagatgctggaaggatggctgggagctggaaatgggcagctctggctggcgcctcccatgcatggtacaacggggaatagctaactgtcctccacccctcatatctgctgttcattcgtggttgtgcatgttgtcactttgtccagcaaccttcaatttattcacctgcacctgcatcgatccctctgcccttccactcatcaagtcactaaacatttgctgattgctattgtgtcccaggcatgaacctaggctctcagagaacacagataaatgagacatcccttgtcctgttgtcttaaagtagctcattcattcacttaatgattaaattcttattaatgaagtacctgctgtgtggtaggtactcacaatcctgttgaaatagacatgggaactggcctactcttgaaggtgctctctgcaagagaagagcgcagagtaggaaggatcactcagcctttcacggaaagaggtgttcaaagaagactcctggaggagttggcggactcctgatgtcaatcaagaatgaatcagagtattttaggcagagaaactagaagagcattccaggtagagggaacagcatgtacaaagtcaagtaggcatgaggaatcccagggaactcagggaactacaagcagctctgtagaaatgggtgatagcaggtaagacaaggggtgggaacagtgacgggagacacttgagagatgggcttgagtccaggtatctggaactgtgtccaccaagataaagaggttagactttatcctgggcacaatgaggaggccctgatgagctctgagcaggggagtgatctaatgagacctgcatgttagacgatcattctggctgctatatggagaatgaattggagtgaattcaggatgaagaagagcaagggagctgttgaggattcctgtcccttatgcaatattcagaaagaattggagagaacactctgtgggtgctggcgaagattcttagatgtggacatgcagctttgccatttaatcaggtctggtctgtggctttgcatagctccctgagagtcagggcctactaataattcctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgg

SEQ ID NO: 577 - DNA, 103915 bp, Homo sapiens
gagatggtagagtttgatatgggacatatggatatattgacaagtgaagtgctaactacaaattataaatcaaactgacagaaagaagaaattaagtgtatagaagaggagatttgagaagaaagaaatgagttcagtttgggatatattgagtttgaggcaccaacagaggaagataaatcaaactggtatgaagcaataaaagtcagtctacgctgagaaagaaggtgggcagtatgtgattaaaggaccaattctatagtcacaactacagccacaaaacaaagaaaacggcatttttcacatataagcagtaattagatctttgaaatatgtactcatcttcaggacaacaacatatacagcaatcacatacatattattatctaaactttaaaaaagatagattgcattccctgatgcagctatattctgataggcaaataagaaaaaattatcattgttggcataagcacataggcacaggtatgagaccatagccagcttatccttctgtggcagataaagctaaccactcccccaccaaaaaagaaatctgggaaagaatatttttaggagatgatgtcacccagcttagctaactaatagagaaccaatagatataactgatatacagctgatatttattacataaataagccaaaaagcaatgaaatactccttggcacgataatgccaggagtagtcacattagtaaaaggagtatgtttttatcacattatactaggctggttgtctctggggaatatttactttaataagagatgtttgcttctcaggtaatcttaagaaattcaggcatagctctcactaatctcgaatttgagtatccactctctcctacctcatgaaagcagaaagaaaagcagcttagtcctgtcccttcaggttgaaattcctgggtaggagagattctccctgatcaaatggcctacagccacggaaatcgagtttcaattaaggtaaaaagaatttcctggggaaaatgtagagacaataccctgaaggactggcctggccaagcaggctacagtgaggggacagtgggagaacagcagttaggagagaacggttggaaataaagagtatctgtatctaaggctctaaggtcttttcctcttgtgaaattcaaaataacaagtaagttatataaagtccctacatctgttcttctcacatcatactccataaaatgaacctgacccttagctgaaataattgtacacttctgcatagtccaacgtgttactggtcctaaaggtaggtgaggtagtttgtacctaggaaagagatggtagctacttttaaattatctttcagagaatccagcagagaaatcactaaagagatacctgttccttctattgattatcagcatattcttagtattgctaaaacaaaatgtataggatgcagctgctcaaatttccccagcatggaatttcctactttatctcatagatcaacaagacactatcctataaaacagtaaaagggttttaccacacgctccttacttctctctaagcaaagttacaagttacaagagttttaaattacgctatatgtggctcattatattttaattttatttcaagattactgtttgtttttgaacttatgtgttatggtattcacctaaaaactaggaataatggagtaaagatcgtggttattgccctcaagcagctcacattttagtgggtctgccagataagttaacattaattacaatatagaatcaaagtgctataaaggtcattaaggagtcagagaagaaaaacctgagaaagagtagtcagtgaacaacttcactttagctgaatctcaaagaataaatacaaattagccaagtgaagaaagaaaacagtgtactggacaaatgtatcagcagatacagaggcacagaggtgagtgagcatgaacttaggaaaactgtaaagttgaaattgctgaaatgtaggtcaggtggaggtggaggtgtgggagatgaggtcagggcccagaacatgaagaacattataaacaacattaaggagtttagatgttaaccttgatattacaaaggatttttttttcacaaataatgtaatatatcttagaaagatcactcttgccacaagatagaagatggattgaagactgaaataaggaaaaacaagtaatattttatatgtttaattcaaaatagaaataatgagagcttgaactaagtcaaggacagctaaatggaaaagaggaactaatcaaacaggcactgagaagatagaatcattaggtgttaatgatcaacaggagtagtcagggagaaaagagtctagaataattccaaaacttaaagtttattatagactaatagggaatttttaaaaagggaccagtattgctggaaaaaaattttaaaagggaccagtattgctggaaaaaattatgagctcagacacttaaaacttcagataccggagaccatctaggtagagatgttcaaaaaagtaactggttatgactcaaggacatcaacagcaacaaaaaaagaattaaaaagaagagaaaaacaaacaaaagtgattggcagtgttgaaagccgaaagattaggagaaagctcaccttagagacataaatcacctgtatctcttaagatttccttctgggagtcatcagaatcagaatatggatagcaaatgagaaagtacacacgagaaaagtaacaagcaaaggattggaagtacagtacataaacatttaaagatgtgtcaaatgaggactaagctctgattttttttattttgcccaaattcctatctaaggggtctagggagtcacgccctacaaactatacattcttatcagatggattttatttaatcctatatatagtggcttactttccaatctgactctggcataacattatgagacaaggaaaaaaaatcaaaatgttttacctaaaaatatatttccttgccataccttgaaattgccctgcaaagtctcttgtgggaaaaatcaacactctatagagaataccctttccccttcgttttccttcctttccagatgcaggagataatcaactaagagccaggcactcttttaggtctgataagaagcattttacaacctgctccctctctctgaagtctgctatctgagagtttcctctgcacaacaaaacttggtctccacaatcctgtatcttaacctgaacatttcttttgatgccagtcttcagatagactcaaccaattgtcaaccagaaaatgtttaaatttacctatagcctggaagcccccactttgagttgtcccgcctttctgaacaaagccaatgtatttattaagtgtacttgattaataactcatgcctccctgaaatacataaagccaagctgtaccccaaccaccttgggcacatgttctcaggacctcctgagggctgtgtcacaggccatggtcactcatatttggctcggaataaatctcttaaaatattttacagagtttgactcttttcatcaacaagaaacataaaaacatttaaagaaggccatgaaggactgcttggagagggggagaagatgatgccctgattcggcatttaacaaatgtttattaggtcccaatcatgttcccagacactcttccaagacagtagttgggaaaaaaaaaaaaaaaaaaaacaggaggaaatgatgttacattttggaaagaagtgtttccaagaataaagtggtcagttatgtcaaaattaaggattgcaaagtgtcacagggggtcattgttagccattgttaggggaattaatgcttataatgcccaactccattaaaataaagatagaataagctgcaagaatagtgataccagatactgtgaagcagtacaattcaacatgtgaaacactgacagaagtcaaatttgtactccaccccaagaaacctaaaccttcccttatctgatcagttatgtaacagaataatggatcctggcatttgcttgaaaatacatagtgtaggtatggggaaaatgtaggttaagaaaaactatcatttggacggtattaagctccagaaaatcaccagaatagaaaaagtagaaagcaaaattgatgtatttatttttgactaagtcactaactgcaaacaaacgaggagagcaaatattatttaaattatccatccccactccactggtcaaaaatataatttttctttacagaatgtggagaaaaggggctcccctgaagtgtgttaaaagagatgaggacggtcagaaaaatctgtctgaaaaaaaaacggaactatctttaaataatactgcaaaatagaaatataagctacatcttaataaataaatgtctctggttaatgggaggaaagatgtgaggcaggcaggattacaaagcaacgagacagcgggaggtaagggcacaggatttggagactcatatattatgtcaacacagccaggaaatcaaaatcctagacctaaactgcacaatcaaaagtaggatgtagacaactattgcggaatcaaaagtcctagccatatgctcaccagccttttgaaatgggacaagtgatactatcagtctcatctgtaaaataaaagtatagtgttttccctgcctacttcatgttttgttatgtttacaaaatggtactattccgctctatgtttaactcacaagcacgcagaagcggagcaggctgaagataggatgcctgtcacaggagctctgcctcttcctacatcttacctgtcgcctgctgcttcaggaaaggtacctggtaggatccaggacccacatgggcctcagtgctgccaccttcagccaatttgagcaggcggggagcccgatcatacatagtgctcggggtggtgggggcgctggggaagggcaggtgccgaaaacgataaaaacaaggtagctagaagtgtggagaaaaaggaagccgacaccagtctgaggaggccgggaaagaacttccgtaaacagggaaattaggggtggggttgtctccccgcccgctcattgataccagatttcctcaaatcgatttctagctctgtggtaaagtagaggggtgagcgactagagattagacgtcccacacaatcatcagtttgccaggtgcacgccaccaaaattgggtattagggattagacgctcgccccggtgcttccggccctgactccgcccacttctctccgcccggaagcctggggaggaggcgggcccagtctctggggaggaggcgggcccagtctctagggagcgaagtggaggtgccttcctgggccgagccctcggagcatgcgcaccgagcagccaccctttcccggctctttttacccggaacccggcgcgccttgaagaaggcaggcctaaacctcgtagctcttggggtcccggtaactacttaggtcccgaacttttttaagtatgcagaagaaccttagaaaacgcgttaggaagggtgaggactaacttgaccttgatctgcttcccgactcaacagaacctagtaaagaaaaatgcagtagcatgaagcagagagcttggggttccgcaagctctcccccgcttctactgcagccccactcgtactcacagagaaaaggcacctctgatcttaacctgtagatagtccaaactgctaagacaaacccagggctcagggcagtgacaagaaatggagaacccagaaaaaaaaataacaaataagataagggtaaaaaagaaaaaaaaaaaaaaagaaatgaggacaccaggcaaggaggcgaaaagctcaccaactgaagccgtggaagtgactgaaagctgcctcttttgtcgtatgccaggtaaccacaatactgattcatcaatatttaaaaagcaaagcgaaggcactgaaaaagcccagtccaccccaccaaaccaatgattctgaaccttgggcaaaagaaaccttgcttgtccttggggcttaaggaatctatgtcagaatccacctctgcatctcgcaggctgttttttctagcaagaattctgtccagattataaatatcctcagaggcttagacaaatcctaccttgatcatacctcacctccaaatggtctacagtacgttaatttgttcctactacaagtttttatagttttcatactctgtaatacacgatttgccactcaatcctgtgcaacatttactgtggcttcattgtgccatataggtcggaaccctctccttgcgaggctatatgcttctcaaggatgtatctgtagtacctttttttctgttcaatagctagctaaattatttatgcacttaaaaaacacgaattggcatatactgtaggttccatccctgctaagttatgaggatacaaaggcataagaaagtccctgccctcaggtgttctctctctaatggggaaagagacgtataatccaaaacgagaggtggcaaagattttttttaatggtaggaaaatgaatattgcaatattttggaaacatctcaccaacttcgattctccctgcattctgtcagaaaccctcataattctctcaatgttgttttaaccttattttccaagctgccacctatacccattcagaagatctagatatttactatgacatattagaaagagtcacagagatgaaagagaaaaattcatgtgctgtgtatgataatccagtggtgcttgtaaatttgcccgctatgtccttaaggacatcatttgaccttgatgatccaaacaaggatatcaacccaaactgcatactcaggtctaggccatggttgccgtaagcattgatgcagaatttcaagccctgtctggccattctgtctgcagtagtctacattactctttgcttgaatatacatatttttggagattggaaatggaaatggtaaagctggctttatatgctttctgtctgatttgattttcagccattgaatgtaacctaatttagacaaagggagttcttcatagcacccttcctagctcatttgcagacctctatgggagagtttctgagtaccagctaggaaaacactgtttatttaccttgcctgcctcctgagtgaatgctttttcctcaaggacttcacagagatgggtagctgatcaatggcaggaccccagtgtttgtgggtcttctggccagatcctacctaaatattacacactgaagtgcaacctatatactcttcataatttggtaattggtctctcaaaattctgcattcttaacaaaaaaaaatctttcttttaaaagtttctatgaggccaggtgcagtggttcacacctgtaatccttaatcctagcactttggggggcccaggcaggaggattgcttgaggccagaagttcaagaccagcctgggcaacatagggagattccacctgcacacacacaaaaatttttttttaattaaaaattagccaagtaggaatttgagattacagcaagctatgatggtaccaccgcactccagcctggaagacaaagcaagaccctgtcttaaaagaaaattgtttatgagaacacttggacacaggagggggaacatcacacaccggggcctgtcgtggggtgggggaaggggggagggatagcattaggagatatacctaaagtaaatgacgagttaatgggtgcagcacaccaatatggcacatgtatacatatgtaacaaacctgcacgttgtgcacatgtaccctagaacttaaagtataattaaaaaaaaaaagaaaattgtttgaatttccttttcaaacaattcaaatagtatgaaaatttctatttccttgatgactgtggctactctctatatttcccagctattatttcctccttatggttcagtaatgagaatggtacacagtatttcaagattggaaaatattttttaatgagaaaaataaatctttttcattatctctcattgtaaatatttcttcaatagtctggaattagtatactaaaaaaaatatgttaacacagaattataattacatataaatatgaaataatttggttcagcatttctcaattcctccaaaagttttaatgctaattaaccacactatgtaaacattttactgtattagtaattccatagatggaatttttgtttgagctaagatttattggagttcaaaatttaggttctttccatttctccctgctggcttataccagaataaacttcaaaatgaagcttgaacaagaataaggtccaagaaattaaactgattcaatactgaatatgttggctgcagtgaagaagagaaaaagcatattgggtaaaaactaaagaaatccaaataaagtatggagtttagttaataatgtattaatattgtttcattgtttcttcctatttgctaattccatctacacatacacaaaaaaaaattttttttgaagacagggtcttgctttgtctttcaggctggaataccatggtaccattatagttcactgtaatctcaaactcctgcctgctataggagcaaatagcagaaactctctatgggttatagattgagtttctctctgtactttataatttttctaaaaatctaaaacttttctgaaataaaattttacctaaaaaacaggcatgaataccagatgaaaattacaactaagtcttacataacttaaaaaagagataattccaatgttatttaaaatattccatattgtaaagaattccttccattttattcatgaatgtatataactttaatactaaaacatgttcaagaatccaccaaaaaagaataatacaatcaatctctaccataaatgtgtatctaacaaataaaatgaaacattagcaaccagaatctagcaatgcttttgtatgataatatattaagaccaaataagtaaattctctaattgcctggataattcagttttagaaaaccactacataatcttctacattaataaattatcaaagaaaataatatatgttcatatcaatagatgaagaaaggacagttgagtgatcctcctacctaggcctcccaaagtgaaaaaaaaaaaaaggaaaagcatttgataaaattaaagagctatttgtaatgataattctacatttaatggaatttgaggaatactattttaatataataaaaaataccttaaaaattaaaatcaataaagtattatcccaaccagcaaatactaaaactatttcaattaaaataaaaaataaatagaaatgcctctatcattattactattatctagtaatggtgtatcatgcttgcttcgacagtacatatactaaaatagtggtgtgtccattgaatacaacaaaattaagtaaaataactggtattagttggaaagaaagatataaaaatatctctttttgcctatgatgtaattggatgccaaaacagtacaggaaaatgtaataaattaccctaagattataaaagaattaagtgcagtgaccatattaaagttaaatatataaaaaacagtagtttttatctatcctaacaattacctaaaaaggaaattggaaaaaaatctcattttcaataaagacaaaaataatgacagaattatgcaaaggaaaggcatagaatctaaacaaagaagataggaacaaatggaaagatatcaaagttaaataggaaaacaatattaaaatatcagttctcccaaaactaatatataattccaattagaatccctctgattttttgatataataatgtgggggaatagagagtatgaaaaaaagaatagtgaagaataactctgatttccatgaatcagaagatacagtggctataaagccattataatcaaatcaatgtggcattggcatagaaaaagacaaatagatcaggagaactaaagaaagaatccggaaatgttttctagtgtatgtatgttaatttgctcgtgtgtgagtctgtgtggtgtgtgtttatcttccaataaaactttatgggcactgaaatttgaatttcatatgatttcacatgtcatgaaatattattctttaaaaaaatcttttcaaccacctaagaatgtaaaaaacatttttgtaatggtatgagaataaggaaaacaataaaaaatgcagtactttctttttaaaaatatgaatggaatggtaaggcattttacttttctttctaagaacgtcgaatgaataataaataaaaagtctttttaaagtatgatgtgtgcttttagaaactgaaaatggatgaatttggcacttctcattcttttaattcaggatgttaaaaatggaaactctatattgaggttcaaatctcatgtagctcaacttataaattgttgacaacaaagtttaagaatatatttacatggcatttgtaaaaagctactgtcttgcataatggtcccaaaggagtttattatagttttaggagattctcaattgttgggattctgtctcagcatggtacagtgtttcactaaatataggtagctatatttttctattatatatacaaaccgtattaaattgatttgtagttctcattgatttagaggctaaggatagcctgacttcaggctaagtactttaaaaataattaccttgaataatattcagccttaaaaaggaaggaaatcctgtcacatgatacagcatgcataaaccttgaggacactacactaagtgaaataagctagtcaccaaaagacaaatactgtgtaattccacttatatgaagtatctaaagtagtcaagttcatagaaacataaagtagaattgtggttgccagaggacagggtgtgtgggggaggaaatgaggagctgtttgaggagtatagagtttcagttttatgagatgaaaaaattctggagatccattgcacaacaatgtaaatgtgcataaccttagacacctgcacattttaaaatggtaaattttatgttatatgttttttgtcacaattaaaaataaaaaaaattaccttaagttacatgagtgcttgtaaaatctctgatgtttgataaagcatactttattttcacagttgtaatataaaggatttgttgacaacatgttttttccagggtaatggaaaattctattgaagcccagtaaataacaagtatttattaattgcctactatgaacaagacattgagagttatgcataacatttctatagaaatgtagatatgtatatatagttgttggcacaagtcccaaaaacataaattaaatgacaattcaagagacaaaaactgtcaagaacataatagaagtcacagcacagtatatgattaatagttaagtgaaggttactagataaatctttagcctaatttaacaggtgtaataactaatataagtgatgtgcatatgtcctacatatatgggtaggtagctgcagaaatgtttcctaacatatttgtagtagaaaagaattgatattcattacacatcattaggtttctgcacaactcttctatatatggtactcaaatttacccttattagctcccacccccacctttttttttttaatatataaaggttaggtctcaaaagtaatcaggtaatttcaaattcatgcaaacaaaccttggaatatgtaagtgcaaagcattctaccaattagtgtcagctaccaatatactaaaataaaatgttttttctctaccttctctctcacattccccctatttatcataatgcaacctttaacttctcttttcctgctcttatcaaaacacacacacaaccctgattctcccagttctcatagtagggtctggggtaacaatacagcagacaggggaaaggcaaggaagggaagaaaaggcttcagccatcaagggatccttcctcccttccagtggatctttcctcccttccaataagaatctcataatctagtagtcttcagcctccttacaactcttctcagtcccctcctcactagtacactcctcagagaatgttatactagatgaagcaaacaaatcttaggaaatgcttggaatgaccacactaattcctagggattagctagaatattttcctgtgcctgaaatacactcttccagtaacatgtgtcctaattttgtttttatttttgtaatcatatttcttatctgtaatattaggggatagacaaatagatgtctagacttattttaattttcaaactttgagattctagaactgaaaaataaatcttaaaaaaaaaaggtttttttatttttagtaaagggcactagatggcacaattccaccaatttatgctaataaaatcactcatccttttattcacatataaaataatttaactttacagttacacttaaataatttgacagaaaacctatataacaaaggtaaaagttcttgaaaatataatatttctaatataccacattttatatccttattcattaacagaataaccagaatcccaaccctgcatgaataatttgttacccaaagtaaataggtatctctctataataaaatgcagcaaaaacttacagatattgaacattaatttgtatcaaatgtacattttatagtattactgataatataataaaactctatccaacaataaagtgaactggtggttccattgactacaaatgcttaaaataaggtactagaaagactaaacgctcacaagtctgatttatttttactaactgcttgccttagaccttagtttcctcaagcctaaaaatgaaaaagttgatctagaaacaatcagaaatgattaaggtctacttgatttagcattcagtcgacctcttattcctttaaagtaccatatttaccacaaaagtcccagatctgtccagtgtttttactatcacttcattccctgggattatttatagttcagaaaacttatcagtccttaagctacattttgacatataagacacagcacatcagccaaacaaacagaatgtacactgcacttggaccatcttccaactgtggcttaggctcttggagtagtcctaccttgccattagatggcaaacactcctgctaggtggtgcaatcaacagcggtagaaagaggttctaagagagaaatgcccctacttagatattcttgcctgatgaaaaactcttctcttaggaggaaagtcatcatcttgggcaaaagtaacagcttctagaagttcacatgtaaagaggaagtagagaaaatgacatctaccttgctaaatacactgtcgcaagttattctacatattaatggagggacatggtatacagctagatttcttttacattgcaacaaactagacagagcagggtggtggatgtggaggggagggggaatgaaaagaagttacaattcctacagaggaactcttaaagaagtaccggagactgttgaaggttgtgtctgtaaatggtttctcaatggtaatactaagtgggcagcggtttcttacaggaagttgttcccaggtacctaaggcagcttatctataacagctggactaatattctctctatatctgccataatcctattaaatgttttacagaaagacttgtaagaaacccaaattatagccataatgctgctgttatctataagctcaacaagttaatcagctctctctccctctttttttttttttttttttttttttgagacggagtcttgctttgtcgcccaggctggagtgcagtggcatgacctctgctcactgcaacctccacctccctggttcaagcgattctcctgcctcagcctcccgagtaactgggactacaggcacccgccaccatgcccgcctaattttttgtatttttagtacggggtttcatcgttttagccaggatggtctcaatctcctgacctcatgatccgcctgcctcggcctcccaaagtgctgagattacaggcatgagccaccgtgcacggccagctctctctttttaagataatttaccatgataggatggagagaattttttgtttttgaatactaaaactgtacttacacagcctcttttttgtctctcctaaaataatttttaaccagtattctaaccaccatgtattaaacatcatgaaaaataatgaggaaaagagtactatccagatgatagtatttgtaaaaataaaatatcaatatatggtatagagaatatatgaacccattcaacacttttaagagaagcattataatgtggttatataatggacattgcggtttattccccaacatttccattccatcccagaagactatgtgagcaaattatggtaattcattccctttgtcattgattagttcagaaaaggacataggacccaactgtggctgtggtaggcatcactctaaaatggctccccagagatttcccattcaaattcctaaaaactacagatataatgagatggcactctcatgactaagttatgttataaggcacagcttacctaaaaatagggagattatccaggtgggccacatctaattacataagcactaaaagcagagaggttcttcagctgatggcagaatggaaagtcagagagagttgaagcatgagaaggattcaagggaaccacctgatgagggatgcagagagccacaaggggctgagaggaatccccaactgatagcccacgaggaaacaaggacaaaatcctacaaccacagagaacaggattttgtcaatgaacttagtgagcttggaagtagattcttcctcaaatcctcccagcccagcccatcctccactttggattgggcattgtaaggcactaaatagagaacccaattgtgccccccaggactctgacctacagaactgcgagataataaataagtgtggtttggtgctacaaaatgtgtggtaatttgttatgacagcagtagaaagctaacacagtagccaaagagctgtaaaatagagacttctaggagttctagggaaattttacttatttctaagtaaatatttctaggtatttattttacttatttctaagaaggagccgcagaacaaaatgttgtctcttctttctctagatattgcattgtctagacctaatggctagagctgacttgtcgatgtagaggattatgttgacagaatttctgaaaactagatcaccctacaatcacagaataaaccttatgtggcaataatgtataggacgtaggcagaatagaaattgggcaactttagatcctcatgccattgaagaggttaaccttggagctgctaatatgtgagataataaatttctttattgtctacatgagtttgagtcagggtttctattacttacagacaaaatattttaactgatgggcttgttgacataaaactagtcaaattatatctagaaacacagttttaggtgaaagaacactgggcatagaaacaagacacaagataacaccatggtctggtggtctggttgcttattacctgtataaccgtgggcaggttacctagtctcactgatcctgtatttcctcaggtaaaaagcagaagtactaatacccaattcactgggttattgtgagaattatctatgatacaaaatatgaagttatgtagcatagcatctgaaataccataattattcaataaagggtctttgtcctaaaataatatgtaaagcaaaagagaaaaatttgttcaggaagaaaaaagttaatcaagaaaaatgacaagtttttttaaaaggtttttttcttaaaggtatggtaaaggataaatgcatagaatgttaaatatgaaagccaagtattctaattttattgttttattgtctggtatgatttattattgaagtatacaaaactttcagaaagagacaattttaaaagattatatgtttgctatgttacaaaccaaatactaatgttaaaggaaagataaaagattgtcttaaagtcataaatacggtttgcaaccaaagcaattaatgtaaccaacttacattgactattttgttccatcatgtcatctgattgatttaaattttaaagtattcactagtttttatgagattaaaagagatatctcaaattaaaaataaccagttatgaagcacctgtatggtttaagaactgagtcaccagatgtctatattagtttgctagggttgctgtaacaaagtaaccacaacctgggcagcttaagcaacagaatttattgtttcacagttctggaggatagaagtccaaaattaagatatcagcaggactggttccttctgagggctgtgagggaataatttccaggcctctgtccttgactggcagatgatcctcttttccctatggttcttcacatcatcttccctctatgcacacccatgtctaaatttcctcttcttataagtaccccaatcatattggattagggaccactctgaatgccttattttaacttcagtacctctgtaaaacccctctctaagtaaggtcacattgtgaggtaccgggagttaggacttcaacatataaatttgggaggacacaattcaacacataaacactatctgaaacacattctctgccctcaaggagctttcagcctaatgtgtgatatatacatttattctctatcttctatttattcaactttgaatttaaagaaaaaacactaagttgcttttgtaatgatgataatatgaagtattcaaattgcatgaattgtagtttcagttgtgtttcgtataataccaagttggtactttctaaaaataattatcttaaatatatgtctcaatatttgcttgaattcaattattgtttccttcatattggggaattgatttaaatctgatatatccagctgtagttatatatttatttaatttctcacacatgtatctaattttcttcccttttaaatctgcatatctaattaaattgaacaaattcaataaagattataaggaagatatctctgtaatgacatgaaaaaattctacctaataccaatttatatggttacaaaatttaaagtttggtcaacaaaagtgaatttttattttcatagtatgaaatgccaaaacattgccaatactcaggaatttgtatctagttagttaaataagtataaatacaggaaaggtcagggttgagatatagacttgtaagtcagctcacaagatatattaaaaaccatgttagcaggagctgagtgcagtggcttatgcctgtaagcccagcactttgggaggccgagacaggaggatcatttgagctcaggagttcaagaccagcctgggcaatatagcaagatcctgtctctacaaaaaataaaaaacgttagccagccatggtggcacatggctgtagtcactgctactcaggatgctgaggtgggagggtcacttgagtccaggagttcgatactgcagtgagctgtggctgccctcctgcactccagggtgggccacagagcgagactctgtctcaaaaaaataaaaataaaaaccatgtttggagaccgatttgagtaataataaaactccagtctcccacacagccagctctgtgtaaattactctttctttattgcaattcccctatcttgataaatcagctgtctaggcagcaggcaaggtgaacccattgggtagttgcaaatttggtgacttgtctaggattgcccttgtggctacctgcccatggttcagtagcctccctccagtgatggatccagaggccagctcaagtgattgagacatgtatttaagatcattatttttagaaagtaccaacttagacacacctgaaactgccagacacacctgacactacctgaaactacagacacacctgaaactataattagtgcaatgtattacaattactacaattagtgcaatgtattacactacactacaattacactaaaactacaattagtgcaatgtattacaattactacaattagtgcaatgtagtttcagacacacctgaaactacaattagtgcagccataccagacacacctgaaactacaattagtgcaatgtgaatacttcatattatcatcattacgaaagcaactgagtgttttttctttaaattcaaagttgaatgaatagaagatagagaataaatgtatatatcacatactaggctgaaagctccttgaggagctttccagagaatgtttcagatagtgttatgtgttgaattgtgtcctcccaaatttatatgttgaagtcctaactcccagtacctcacaatgtgaccttaattagagaggggttttacagaggtactgaagttaaaataaggcattcagtgtggtccctaatccaatatgactggggtatttataagaagaggaaatttagacacgggtgtacatagagggaagatgatgtgaagagccacagggaaaaaaggatcatctgccagtcaaggacagaggcccggaacttattccctcacagccctcagaaggaaccaaccctgttgacaccttgattttaaacttctatccttcagaactgtgaaacaataaattctgttgcttaagctgcctggattgtatttacttgttacagcaaccctagcaaactaatacagatagctggcaactcagttcttgaagcatgcaggtgcttcataactggttatttttaaggtgtgatacctctttagtctcagaacaactagtgcattccttaagtggcctagttctcttggactaaggttgactctggtactgtctcttctggcagggtgctgctgacccagtgtgcatggacttcattgatatagagaaatagtcctgggagacatcccataattgtaccccatggtggggtgtctttgtctgtagccccacaatggagtatatgtaactgtagtcctatcacagggtacctgtctatagccctgtcacggagtgtttatagctgtagccccattatggggtgtctggtttggtgagtattttaggtgctgccaatgcctccttcctcctcccagttggtttggctccctcagaggtcttggtttttctgtagccctatggtgagatgtctgtctatggccccattcaggggtgtctgtctcactttggccccttcggatgtctcagtttttctgctcccccatggtagagtgtctgtctcggtttggctccttcaggagtcttggttggctctctctaattagtagtaagagtcttgggaaagctctcagtcaggaagatttcagggagagttctcaaatggagaataggaggatagtttggaagggatactcttggaattcttggataaggaccttgatttggaagtccttctgtctattttgtctttgtgtgtgtttgtatacgtggaggggatttcaaaagaaattactgacagaactccaccaggcctaactcagagaaccctccttacttgtctagtcacatttggtgagccctgaagaaagttcaacaggcctgagttggggcaagtatctgctcttcatcttgcccagaggccacctattgaattaccagtcagagatcatccctccccacctggagtggatcaaagacaacagggaccaacaggagaaagtatgagccttgccaagtccatattgggtgctgaacaaggtgactagtgtccattttgttatgtgcattttgctttgactgggatggaaaatgctaattcaatgccccatgcagcccattgggcagcatcttgcaaaattgagaatcttttgcctatggtttcatgaaacagaaaagggtaatttcattttgtaaggtggcttgagcacagcaagcagggccatcaaaagcttgctccattcttctggaaactgcagagaaaggaaacccagaaacctggtgtgccagcaaaaagggtaagaaattcttaccagccacgtttctactctctctctctttctctctctctctctcgtgtgtgtctctgtgtgtgtgtgtgtgtgtgtgtgtgtaatgataaacatcattatttgtctcctctgcaagagtttgattaatagaaataaaaggatttgtgagactagtcttaggctgcagcaaatctggtttactttgtgctaagaatgtgtctgtaatggagacaggggtatcacaggatagaacatgtgcttaggacctctataagcctgctttccatccagcccagaaaggtgatcggttacaattttttctccaggtccctgaaactaataccgaatgaaatttctctgtctagttttgtgtttttaagagcttaacattgtgaccatatgaggatactttctcttggtttctgccatccagaggacaagaatttgggggttcatgtcatagttagccctaaaaattgtcttgagcagttaagagcctttgcaagattgaaattggccactctagacttcttctgggaagagcaatagaaactgctccatgctgtgtagctcagtagctaagcctttgtcttttgacaatggtggcctgggttcaattcttggctactggaatgaatcctttctggcttgttatttgtgtaactttgccatttgttgagggtttttcccccttggatagcttctgattttcggtcttggattttcctttctctaaactacccttggggagattctaaatcttgtagaaaaaaagaaactgcttaccatctctctgagacactttatgcgtgcatggttaagttataaccttagttacaacttattaatttcatgtgggaagttacctgtggtagaattcaaaagccagaaatattggctgccctggttagagtcggtaataagagacttaaaataattttttttttagaaacaaagctctatagtaaatatcagcttaattaaaaacaaatatccaagctgtatctatttaagaggactttatctttcttttcttcttgaatcgtgtttttccgaaaaaaagttttttctactcagaagactaaattgttcttctccattttgtcttcttgccactcttgatacccacatcagagaaactaagataaattctaacagcctgggactcctggggaaaagcagaggaggcaccacagaccccattctgggaaaaacctctgttttccacacagaagcccagaaattgaatgagaatagatccctctcaaaatcgaaggctctgttctgttttgcattgttttaactgatgcttttgacttttgtgggtatcagaaattacttcacattataagggaaacttggtgtgtactaactaggcaggaaatatacttttggggatggctaatggcatttatggggggatacacagctctttgatgtttcaattagagaagcatgctcttagccacctaaaatatatggaaacatccccaatccccactgaaagagactccaatggaggatgagctgattacaaaatggactgtttagctttgggttgccttgcaatgaaatgcatggtagaagcactgcactattttctcccatagtatttccctccttttggggtatccaggatccagtataaaatggcacccttaattttggggatctgtctttgccttccagctgtgcctgcttattgggctctagaaactacatactttcctgaccctgttcctccaagggctctaccctgaagccagtaatccaattaagatactactaaatgggctaggtgtggtgactcatgactgtaatcccagcactttcggaggctgaggtgggtggatcacctgaggtcaggagctcgagaccccccagcctgaccaacatggagaaaccccgtctctactaaaaatacaaaattagccagatgtggtggtgcatgcctgtaatccctgctactcgggaggctgaggcaggagaatcgcttgaacctgggaggcggaggttgcggcgaggcaatattgtgccattgcactccagcctgggcaacaagagcaaaactcagtctcaaaaaaaaaaaaaaatgaaaagaaacagaaacaggtaaatgaaaaatcttacaagtgctgaatcttctctctttctgtctatgtattaatatgtgttatgtgtgtggtgtttatataaaaagagctctgattaattggcttagaaaaataagcacttaagtcaaatattttgtcagaaaaatagaaactttaatgcctttttgttcatgtgactttagtaatcttttggaaataaagacagttttaaagattattgacaaaatgaaaatgtcttccaaatgtagacatttggtctaaattaaggtcagatatcagatttgctaaatgctttaaggtcataaactgcttctttgacttttgaaaattgttccatttacctcctttagagcattagattctagatgaggcctgaggacatgtggagttaaccatgccccctggctatgctggaaagagacaaaccttatcttcatttctgtctgacatcctaggctccacacctagtacataattaaagtagcttacttatcaggttttccccaaaaataaaagttgttaaaagttaacattgtaacatgcaattgagactactaaagagacagttttacatacaaggtgcataaggaaagtagaatgtgtttttggtaaaagcttataagaaggcatgggaatgtggcttttgttaaaatgtaattttgtctagttcagagggttttaaagattgtcttaacctaaaagagtaatgggacaaaactgaaggtttaagcaaggtgaaaagggtttgtgaaggattggtcttggaaagaaagtttggtggatatgagcaatttggctaagattttaaggggataatttaatttttttccattggttgaacattaaagtacaagcacattaatgcagggccagaacctgggcccatgtgtctgaataacagggttttcttagaaaattgttctactgtttaacagaaaaattgtaaagggttccaaaaactttatgaaaatcttaccttatggtcaaactaagtttagtttagttttgttttgttttgttttgttttgttttgtttttgagacagagtctcactctgtcaccaggctggagtgcagtggcgtgatctcggctcactactgcctctgcctcctgggttcaagcaattttcctgcctcagcctcctgagtaactgggattacagccatgcaccaccatgcccggctaattttgtatctttagtagagacggggtttctccatgttggtcaggctggtctggaacttccgacctcaggtgatccacccaccttggcttcccaaagtgctgggattacaggcatgagccactgtgcccagcagtcaaactaattaaaactggatagggttacaaagttttatttagaaactcgttttagcattaaagatgcattaaagcaaacaaaaaatctggttttttctttcaaaaaagatttttatgtaatattaaaagaaaatgaaaggtttttgtttgcccctttgggtaaatggcagaggaaaaaaggggaggagagagaagagacacattcagttggcctcattctgtcttcactgggtcttgtttggaaaactaagtctcttctatcagagtaaaggtttttgccttttaaaaaaatttttttgagttaccactttggataaatgaataacctgttattctattttgtgatattcagtgttttaaacctttgatagttgacagattttctaaaatcaaattatatagtatgtcattttctgacctaattaatcctttagacattaggtccccagaagttcaaaaatgatatgtttggcttatttggtataaaaattatacaggaagcattgtcaaatatgaaatggtgcttggctttctttgggctgtatttgtataaatatgttattagaacgtgttccaaaattatgggaaacttcaataattttgatatgatttagtgtacgttattaacagctatagttatgtaaatttgttgtatgtcacaaaagcaaccaaaattcctagtcaattgtagctttaatagtggctgtcctaaaacttttgtcatccacagacattttgtcttgctttggtccttttcaaaaggtggtttataatcagatataggactctaagtgcagatctctgataactttaaaaattgtgctattggaatagaggaaataaatggaatttctaggactctcatggagagctgatgtgttaaacattgctaatcctcttgttttcagactcaagagaacttatttcttttgacctatttgcaacttttaacaagtgagtaaagtgtactcctgggaacaacatttggagcatattgctttccctctgtgatttcttcaggatttagaaactttctgtgagtattctcaacttatggcagtatgattatttgcataagtgcaataagaatctgtcttctttactaacaggacacaattggagaaactggttattttagcaaggctttcactaaaatgtcattcattctttaaggaatcaaagtggacttatagagccaataaaagcccctcaggaaaactggcctcatgccttgtctacacagtccctgtacagggttcctgacctgtgataagtgaggaatgtcactttctgataggcccagaagtcccaggttatcttgggaccttaaagtgaggagttcacaggcatttgcaggcatagataaatctgtagctgggcttcaaggcttttagaaagtactttttttttttttttggtcaggcatggtggctcatgcatgtaatcccagcactttgcgaggccaaggtgggcgaacacctgaggtcaggagttcgagaccagcctgaccaatatggtgaaaccccgtctctactaaaaaaaaaatacaaaaattagccaggcttggtggcggcgcacctgtaatcccagctactcaggaggctgagacaggagaattgcttgaaactgagaggcagaggttacagtgagccgagatcatgccactgcactccagcctgggtgacaaagcgagactccgtctcaaaaaaaaaaagtacaacctcagattccttatagaacaaagtttcagcaaagccaatattaaagagcctatgtgaaaaataattattcttgctgtactttatacaaataatcaggccaagtataagactgaagtttagtttgcaaatgaatcaatcctatcatgacttgcttttaataaaaatggggactggagagagaaaaattgtgcttaaaaaagactataatatacattcttagctgttcttgggttgttttttgtttgtttgtttgttttttccctgcagtttggaataaatcctaaattctttgtggactacaagtccccaaactaatgttttcaaatctttactttaaaactgggaattgccctctttaccctcatgcccattgtttatcttatagtatgcttttcctttaaatgtggtgctaaaactataggtgacaatactaacgtttttgccatgcaagccttggaaccacagccaggcctaagtgagtatgctcagacagtggcaaagacattccactcctcttaccttggggtcaacgcctaccaccactatgcccctgatcagcaggaagaagttagggtggtctctgcctgtttctcatcttgtttagccaacatcttgagattaaagtgttataaaacccacagggagggattgaaacggccattgcaaaattataacttagcgaatgagatctaacctaaccaactccatcttgcttctaatctccaagctgtccttgttcattcctgggcataggcggaactaactttgggaggaacttagtttatagtttaaaacaaagatggtaacagccctttcccaaaacaaacccccttcttgcctggggattagactacctttgtagaactaacaaatttagccacaagattagaagttattgtttaggagtcacacaactggaggatacaagactctgaccctccctaaactgctcctaagatcagtgcttgaggtattttgcagaccctgcacttgatggatcagctggcaccacccagattgataaactggctcatgtgatcttgtggcccccaaccaggaactgactccgtgcaagaggacagcttcgacttcctgttatttcatttctgacctgaccaatcagcactcccggttcactagcttcctgtcacacaccaagttgtccttaaaaactcctgtcctcgaacgctcagggagacggatttgagtaataataaaactcaaatccgtaataataccgtctccccccaaaaaagtaaataaataaataaaaaacatgttagtggtcatccaacatgaggagaaaaagagagaaaagcagtgcctgaagacagaaacaaatcatgattaatgatttggcagcaaaagaggaggagcctatcaaggaaaataataaaattgtccagggcttataggcatatgtggttagaattagaataaataatgtcagggaagccaagagcagaaaggatagagttctgaaaagtgtttgttcaacaatcagaaataaagagagatttggtaagataaagattgacaagactccagtgaatttggcaattttaatacattatttcagtaaagatcgtttcagtctttaggtggggaaaaggcaaaaggcaaatggcagtgggttgagcagtaggagggacacttcattttctaagacaggagaaaagaaagtaaagatgagtgcagatgtttatcacaatggaaatatgcaaatgcaggcacatggaaataatacaacagcaggatacctaagctcaagtgaaataattacaaggaagaacaatgcttaagagatttcccaaacatcatcttacacaattggactagccattgatgtctaggaaatgtctggtataccaacttcaaatgcagctataagtaaaacattaatttactttctactgtcattagtacaaagtgctgcagtgatggtctcacaagaatttgaatattgggtaaataagattgtccttaaagaggtaaactatgtgtttacatatagtcaatttataggtcaagtcactcgaaagacagacttcttgccaagacaagtaagcaacagttgactattccttattaactatattaatatagctgatgaatgaatgtatccagaaaaaggaaagggagatattgattggctacggaagtagattaaaagaggaatcacccaggtaagcccatctaagcactgggtgtgtacatttgtcttgctggcaaggctattcctgttgagagaactatgtaagtcaggtttctccagaaacaaaagcaataggtgtgtgtgtgtgtgtgtgtgtgtgtgtgtgtgtgtgtgtgtgtgtgtgtgtgtgtgtgtctgtctgtgtcaagaaagagaaagatttattgtgaggcattggcctacacagttgtgggggttataacttccaaaatcttcagggtaggcaagcaggctagagactcagggaagactggcaaggaagaattggagtccaaagggcgtctgctgccagaattctctcttctatgaggtacctctgtctttttctcttaaagcctgcaactgattggagtagactaccaccgatgtccccttaaagcccaagggttaccttcggttaacttatgatgaatgctacctggcctgagactcaccctccaggtcagtgggctcccctctggcccagggaaggtccagaaatgctgtccagcagcctaggcctagatgcggggaccccaaaagcctgctttttactctactcctttgtggttgagctggtatctagggtgcaagacaaagtccactttacttttccttctgcttttctcaaacagaatgagtctttcactgcagccaccacagctgggaatgtgctgggtcaccactaaagtcagcatgtctcacagcccaacacacatggcatactccctagttatcaccgctggttattcagggtgcaagggctctttagtcagcgggagatgaatgccgccaggactgggtctttcttttcaaggcctaaggttcccttctggcccaggatctcatctagcaacgtcatccaggagctagggcttagaaagggggcctcacaactctgctcagtgccctattttgctatgactgagctgatgtccaacatgcaagacaaagtcctctttacttttctttctcctctcctcaagcagaagaaaggacttactttctttgctgagaactgtgctacctggggttgggggaggagagatgcaagcactccgttagtcaccctggctggtgtcccagtaggttgtatgccctccaggtctgccagctccaagcccagctcagcactatgatctgcttaggaactgcagtcccaatgacccagactgcccttcacgtttatttaaagtcccagagcacttttgccaacagtggcagggcttgctggaactcaggttctgactgctgggatgggcaattcccctctggctagggctggtctaaatgtcccctctgtaggtaggcttcagctgagttcagcccagttttgccttctactgtaacagggcaacactgaattcaatgtgctctccctccctcaagagcacagattctctctccttgccatgaagctactgccaggggactggggaggggtgatatcagtgattcgagactgtttttcctacccccttcagtacctctttcagcgatatgaaggtaaaactaggtattggttactcacctgatttttgttttttatgaaagtgtttttttgtgtcaatagttgtcaaagttggtgttcctgttgggaaaatgatcagtagaggattctattcagccattttgcttcatccctccctctagatttgtttgagctgtcctcatggtttcattaaggttatgtatttttggcagaaatactatataagtttcatgttgttcttagcagtatttctcatcaggaggcacttgatgactatttgtcactgtgatattataaagtatatgctttatttgatctccaacccatacaactaaaatccttagaatccccaaagtctttttgtatgctaataattgactgatggttggcagcttctaggtagcttcaggatgggggctagtcactgcaaaaactaaggcaggattaggaggttgagactttcacctctgaggagggtagaggaaagttaagttgatcattaatggctaatgatttaaccaatagtgcctatattatgaagctcccataaaaacccaaaaggacggggttcagagagctttcaggtagccaaaaccatagaggctcctggaggatggctcacctggggagggcatccacatccccttcccatgcctcagcacatgcatctcttcatctatatcctttgtaatatcgtttatagtgtactggtaaatgtaaatgtttccctgagttatgtgagctgctctagcaaattaaccaaatctgaggaggcggtcatgagaccccaatttataaccaattgtcagaagcacaggtaaaacaacctaggacttgagactgacatctgaagtggggagtgggaggcagtcttggagactgagccctcaatcatgggatctccaggaagatactgtcagaaatgaattgaattgaattagaggatatccagctggtgtccgctacagaactccttggtgtggcagggagagggggaacccacacatctggtcacagaaatattctgtgttgttgtagtgtgaaagcagaggaaaaccgtttgagttttctccactcagtcccattattggtgatgttaactttgatcactcaattaaggtgctgtctgccaggttgctcccctataaagttactagttttccttttataattaattggtaatttgtgactggataagttgagaccatgtaagtttcctgttgtgtatgggatagtttagcatccaattgattacctgaatcagttgtcacctaataatagactttttactttccattgcagagaaataattaaaagaggcaatagtcagagactccttgaattcatggtatttcatctgtctctgatagacagctgagctgagaactctaggaaccattccctgcagaccaaaaatgagaattatgctggagattttaaaggaagcaaacatttcaaatttggaagaacctgctgctactatgggctatttggccattagtgagaagaggttcacacactagtttaaatcaattgttcaaatagctgaactctacctgaaaaaaaaactcacatacgcctctggctaaagaatattcctgaggcaaatcaaaaagaacagaagacatactaagatcaagtattagcttaagatgctctgacccttaacatctatcaaaaaagaaaaacaaggtgaccacagatctagggccagtatgattctgacctagattgaggagcggcccatctgtggtttgtgctcagagagaaaaaggggatgtctgcaagggactaaagattctattggttctagcagcagtgggacccaaaattcatctcaggctgcaagaatctacttttgcaaatagtgttggatgttcttcaccttttccctccatgagatgggcagcaaattgcctacttacagggctccttcaagtcatacccactgtgttaggcacagcatggtgctggaaaacaaaaaacagataacacaaataagaagactgtaagaaattttagggataattagtacttgtcgttttcaagaatttttgtaatttcttaaattcccctttgcttattataaggtttaaattgttttggttttggtctgcagttaattaagcattcctatgagttggaggcagtactgaacaaaaaggtaaagatatttcaggtatagattatagactttaatgaaagggcagcctcacatgtgctcaggaaagctgaagtaagcatggatttgtttatttatttatttctttatatctttaacagggttttgttctgtggcccaagctggagtgcagtgttctgatcatggctcgctgcagcctcaacttcctgggctcaagtgatcctcccacctcaccacccaagtagctgggactacaggcatgtgtgccaccaggcccaggtaattttttttattttttgtaaagatggggtctcactatgttgcccaagctggtcttgaactcctcaagcaatccaccttagcctctcaaagtgctgggattacaggcatgagtcactgtgcctggcccaagtatggatttttttgcattgatcttttggagcacacctgtaaaatcaattcaaaattcagtgtaaatgattatcatatttaaaaacaacttgtggaataagagagaattacatccactgtgtgcttaatgtataatctggccctatctaatccttagaagaatcatgtaattttttatttatggaagagaaaactaaagttcaaaaaaatgctatgaacatgtgatgtgtcagttacagggctactgtaaaagcccagatctgatttcagaatccttttcacagtgctatagtgcttacatgttactttcatactaagaagtatttgagagtaacaaaagaaaagaaaatgagaaaaagatgatttgtaaggtaattaagagatgctagttgtacatcattcgaatttgagtttgggttataaaaatctttggtccatggaaaaaattgtaagtcctttgttgctattatctttgcttactgtacaataaataaacaccaggaagaaaaatatttccatagagtttgcttatgaattgctcttctagtcttattttaaaaattatttttctgagcctttgaactgattgaattctggaggaatttattctattccttagaattaaatcttcagattcttacaacacaagtcctttggtctatgctgagtcagtaaattctgtctcccaggcaactttgtgtaaatcaaagctgaaggtcagaccaaaattaatgcattacattaaagtaaaataggattgctttgtatttcaatttgttctatttggttttcagtgtttaaacgcccctattgccattgttggttattctcaatagtttgactctgttgttattcaaaatctaaagaattttatgaaagaaaaattaaattttaaaaagttaaatagtagttaagcaaaataatcaatcaagtaataaacctgcatcttcataagtaatgagtgattaaaatctaaataatgagaaaatattgctcacttatcaagtgagtagatttagaaaatagtatctaggactggtcatcaggtgcagagaaatatttcctgttttggctccacattcctataatcctacacacccctagttcaggccctcattatcccctgcctggacaatctcagcaacacacttctaacttgtctgcctgattacagtattgtattttttaaatcccatcttcacactgcagcctgagatatacagtatacctgaaatataattctagccattttactgcttctgtttctcagtctctcagtttccagggtggaatagttaataatgtatctgtaaagaaatagctaaatgcatggttgcagttcaattttgccatggttagtacagacaatacaaatctcactaagtccaagatttgtcgctctgacagccacaggaagccaaattagaattacaatgttgcttaataagcatggaattagaataggaacattagttatagaattcaaatggctaatggaatcaggttaaagaagcttggcgctctcacctcaccaggacactttcatcagcctgatcattctctgccctgacaatgcttgagtgggtattagcaacttttcattttgggtttccattttctctactccagatagaatttacctttttgtttatacagtctctccaaataaggcataataccactgcttagggttttacttattaaatgttaatcatattctagacctgcctcttgagactgcggccaggttattttgattggagttttggagtattctcaaattctttagctctgcaattctacaaagtctccaagtcgattcctacaaggtcacaaatttatgcaaatagtgctttgcatagagtaggtactcaactattgcttaggtatggggataacctaacgggataactattgcttaggtctggggatgacttagacgacactgttcccggttttttgtttttaagccactaagagtagctttctcagaaggcaatcttatttttcttattgataatttcttgatttgcctctcactgttgacactattaccaaaaatagaccatttgggaggctagctaaaaattttaagtagtcattttgtattataataacttctcaattttatttggctttttaaaaaatgtagcagtgaggatgaccctaagtagataattttagttaacttgtagaataataacccttaatttaagtcaaaatgtttgagttaggggtgtagagtttgaaagttttcattaaattgtatgctacattcatacactcattgcattcttccactgcctgatagtgttctgagccctgtgttctaagcagcaattgttaagaaatccttgtactgggccaggcgcggtggctcacgcctgtaatcccaggccgtgggaggctgaggcaggtggatcatgaggtcaggagatcgagaccatcctagccaacatggtgaaaccctgtctctactaaaaatacaaaaattagctgggtggggtggtgtgcacctgtagtcccagctactaagaaggctgaagcaggagaatccttgaacccaggaggcagaggttgcagtgagctgagatcatgccactgtactccagcctgggtgacagagcaagactccaactcaaaaaaaaaaaaaagaaagaaagaaatccttgtaccattttgtatttgaggaaatggctaactacaaaatacaaccttggcctcacatgtttgaagctgtctccatccttcctcataactctcatatggctcctttgtttatctgcatctataaaaccccaagcctctccctgttctttgagatgctttaatgtttttcattaatgaatgttttccctattgcaattgcccaaataaaatcatccccttaattgtccagcattccttgtcacaaaccaaatcataatgctcaatgccactttaacacaaagttgatgggttaagtgagttaatacatgagtgtatagcacttcgaatggtgtcagacacctattatatgttcaacaatgtgttatccataatacctaaattatctataggtacataggtatatattatacatatattaattacatataattataataattatttttaattgttattaactcctaatcaggaaagacagttcagagaaatctactcatccgtatattttatttccagtgttgcaatctgaactaaattgaccacaggaggagcaagaaaaggtcaagtgagtaagtgggagaacaagggtaggaaaaggaaaaatatatggttgattttctcctatattcccaatgctacttccagataatagagccagcaccctcccttccaatctcatcatttgaaatgtatatctttggccgggcgcagtggctcaagcctgtaatcctagcactttgggaggccgaggcgggcggatcacgaggtcaggagatcgagaccatcctggctaacacggcgaaaccctgtctctactaaaaatacaaaaaaattagctgggcgaggtggcgggcgcctgtagtcccagctactcaggaggctgaggcaggagaatggcgtgaacctgggaggcggagcttgcagtgagccaagatctcgccactgcactccagcctgggcgacagagtgacactccgtctcaaaacaaaaaaaaagaaaaaggaaaaagaaaaaaagaaatgtatatcttcagtccaaatctcttctcccacttcaaagcattatagttctcctctagcaaaatcttcttccttctcctttgataccttcatccttcaacagcatattctttctgtacaccagtatcttctacatactgagggaatttcacagctccagtttctttagttcatatttctttccttccttgactctgtagaccttcatccccattccactagccaagctcctgcagagcctttactttgtttttctcttcacaataactgacccctgaattctttaaatcagaaatcctttaagaaattatcctttaagataatttattttgtacatgccacatttcctgcttttacctcacaaagattaactaggtagtcaccttcatcatgactttaagttaccaaaccattccctctttctcaggctaacctttacctccttgcctcccaacaccctcttcaaattccagtgtatttgtgatgtgttcagcttcagagaagagaaaccataacgaaaagaggcttaaaccaggctagtctgatggtagtgggttatcagaatttattaacactgttgtcactaaagttggtatataaccccccattgctaaattggactggattttaagaagaaaaaataaataagtaaaaatttttaaaaagtggctcacatcaaaattctctgagaataggaaatggttaaaagtaagctgagatatttatcatttagtcttgggtagtcgcttgaggcacagattgtctccagttctaagcagctttgtctagctacccacatgtagcatatgagtatgtgtggtgagacacggaaaagggtcggaagcactggcctaaagaaataggagtttactggctcattttattcccagaccaaaccgagggtcgggctgcttattctcatggcccaataacaagatgcagatgaactgggagagaagagagtttatatctgtaactggttacagggagaaggcctggaaattgtcaccgaccaaatcaaaattacaaagttttccagagcttatatatattcatctaaagacaaaagtgattaacttcttataatctataactaagatgtgaatcctaaagaccttcctctggagcctcagtaaatttacttaatctaaatgggtctagatcctggggtgattatccttattttgtctactgctaagctatggaggtttggggagttcctttagtccccagtaaacttgtttgtggaagtctggggagtttcttcaggcccccaataaaacttgtttaatcctaaatgggtcccattaagaaattccttcattaccttaccatgctttaaggcccagaaaaggcctaggcaaaactcttagtgggcttttgttacattccagcctttgtataagggcactggctctatcagcttttaatatttaacttaaccactcagttagtactgaaacagttgttatgaaggcctgtgttagtgagacctggcctgccacaaggtgacacaaatcccagggtagaagttctgggctgatacttacaatgccattgggcacccatgcactctctacctttttggtctgccatccttaccatactgtcatttttcttttactctttgcctcatggtaccaaatgacatcagtgcctctaggcctcaaaaccacaaaccaggcaaaaagaagagagggaaagtaatggcaccaaatcacatttgcttataatccattggctagaaacatatcacatggccaccatagtttcaagaaagggtgagcaattgagtctttaggttttacagacaccctaataaagtaaagaaaaaggcaggtgggaaatggagggagtggagtgggcattatgggagctgtgatggttaatactgtcaacttgattggattgtaagatgcaaagtattgaccctgggtgtgtctgtgagggtgttgccaaaggagattaacatttgagtcagtgggctgggaaaggtagacccacccttaatctgggtgggcacaatctaatcagctgccagcgtggccagattaaaagcaggcagaagaatgtggaaaggttagaatggcttagcctcccagcctacatctttctcctgtgctggatgcttcctgcccttgaatatcagactccaagttcttcagctttgggactcagactggctgccttgctcctcagcttgcagatggcctatcgtgggaccttgtgatcatgtgagttaatgctacttaataaatttccctttatatatatatctatcctattagttctgtccctctagagaaccctaacacaggaaccaacatatagaatctgacacaccacaactccaaaatggcaatatttaatacagccatccctagcagaagtcctacaccctagattctcctaaccatgcaatgtacctatggcatcacacccaactctgaatctacctcagtgtgtgctcccagcctcttactaaagaatgagatgataatgaggaaagactgaggtcaattccattattaattctcacactctaattgaaatccagtgtattttaagcttcccttccagtgacatcctaaaataaacctaattgtagttattatgcatctttcttttaaatgcccattgcttttcatcataggaaataaaaacctaatattaaagctgtgttgtgtcatatgtcatgccagaatctcctctatgctcttaatgtcaatagcaaaagcagaaagagcagtagggccatttcaggaacccaggcaagtggcaaaaacataaagactgaggagagggctattgtgagaactcaagttgaaaggggctgatcaggattgcagctattatttggcaatgatatgaagaggtgagacaaggaattaggaggccttgaagtccaaccaaggagaactaatgaactacattatgccctaacttggtctcatttaaaggcttctggatctgtccccaaaagtgtgccacaattattcttaaagtcacagcactctgaatccaccacatgacagattaattaactcttacctccactgcatttgctcttaaatttctctttcttaccttgtcatttcatgatatttcagtattacatttctaactattcacagaataaccccactcagatgttcatcatcttcccaggaacattacagtgatatctggaggaaaatgggaaagaaagtcacctacactaccatccctatgggctcagttcccatttgtagagcataagctatgaagaactccttgcacaaactcctaaggggaagaaaggggcatgatggtaccttgagctcgagcttgaactgagtcttgacactttgctttagaagagtaagagctgaaagaactgccatttcaaaaccgccaacagttttttgtttcacaaaaacatggaaatagatcagagacaactggctactttgttctgattaaacctcttgaatgttatgtaaatgtacagcaaaggcagaattagaagaagacaggattttgtttagttatgcaaaagcttttttacttggtagacaagaattgcatttccacagatttagttcccttgagggaatgtctctcctgagattaagactcctctaaacctgaaaatggttgcctttcttgggagatgtgagttgaggacattgctggtatcagataaggacctggggaccagaggttgaaggaactgcttatgtaagacacattctgtgccctgggcatgaacagtgctgctttgagctccagatggtgaagtgtgatactgagttgaagaggcagcctcctctgtccagaatccttaatacactaacactaaggagtgtcaggttttagaacctcagacctggaaatggtattcaatgcattctctctctctctcttccgttgtctctttctctccccctctctctctctacccccctttctctctctcattgtctctctttctctctcactctctcccattgtctctctctctctcccccgcaattgtctctctctctctctttctcccattatctctctctctctttcctttgatctatgccctctctggtgttttattatctcctactgcaaataggcattctccacaagatcaagaaaaaaaactattggcatctattttcataaatttctaactctggtattcaaaagttagttccatttacaacattcctggtaaaatactgacttgggtcacatgacctacctcaccatagggagaggtattctcactgacctggtctgagccatacacccaaggagataacctttgccactagaagaagtgatgggagttgaccagtaacctgactaacgtacttgacaactaaaaacaaaagctagcacttgcagtatgtgaaaagctgaaaaaatattttatcccaagtctgggcatatatccatagcttcagagccccatctgtgttcccttgtactctcagacaggcccttaaggaaagaaagaacaggcatgttgtccactagcaccaagaaggacacacaaatattcgtgaatgaagacatgaataaaagtaccaaatgcattgttccctaaccctggaccttccccttaaccactttgttcactctgctcttattcttcatgtgacgaggtcacttagggcagaggagacaggtaggagcagtgtggtcttgcttgtcctgagttgtggctcaaaaataagagaaaaggtttgagagacataattcatcttcaacaatataaacttgaacaatttaatccttataagtctgtaaagtagaaatccaagattttggatttttaaatgcgttagttggtatgagtgtgatcaaatttaaactgcctatagagtcagataaacttaatatttatcatttatattcaaaaatatcaggaaaactaactttttaaaagagagaaaaacagtttgattttataacaataatataattgcagtcattaaaaaatgtcttactacagattcctaattatcattcaggacaataaaaattatgcattatgattaagtacgtgtcaaatttacttttgcaaattctatgtgcttctgatgcttagttctgaaatatcgtcaagatttaaatctgcccacacttgtaaaatgaaacaaaacaaaacaaaaacccaaaactagagaaagcctaggttagtatgtcatgagtacctcattgttgtctaatgttacatgtctttgttttaccttcccaactagattgcaaacttcttaagatgttttacatttgtgatgaaataattctaggttgagaatggataccaagactatttagaattcctgatacagacgagaaaaaacatccttcaaaccagtgcttcttcagcctatcagacctaacacgctgtgtttagaacaaatgcttcgaagtaaccattttattatcctgaaatgcaactcattgttggcatgatgaagaagcatacaatttcactataaaaagacaatttagtaccctgtctgtaatacaaaaaaaggaattaagtttaaaataaaataatacattttattgttgtaaatttataagcacagctaaacaagaagacctataaagtaggtcgattcttgcacctattaccatgaaaagtttgcaattaaaagacataagaaaatattcagctgaaatgtggatacttttctttatatttgtttgacatttgaaatcaccatgagagaggcaataaatgctaactgatcagagtaagttataccagcaattcaaataccaggggtagagttggatgtcagtgacaggattttccaaaatggtgaacaacccttgaaaagatttacaagaaaaaactacaattttccctagatttgccccatagttgcattcctaaaaaatttcaagcatataaaaatcttctgaacatacttttgttcataggtagaatggtattggattctaggctcagaaaattataaacaggctttccaaatcataaatatgcagtgagacatctaaaagtggtgcaagacccagagcagttttgtgtttaatgagactgtttctcatagtacagggtatttaagatgcatagctcccaatcactaaatgccagtagtgccacccaatcattgtgacgaaaaaacatctctcacaaattctaaatactttctaggagagtcccttttgagaattacttcattaaagtttgcaataagtttctacctactaagagatggaaagtaaaacccctcagcctgagaaattaggagttctgtttgtaatgtaaatggcgtatatcttttgccaaatctatgcctgcagcagattgtttccaatgagataaacttgcaccaaatatattattgctagttctgtgtgtgtgtgtttgtgtgtgtgtgtgtgtttgtgtgtgtgtgtgtttgtgggagagagagagagagagagagagcttatgttgctcaaatgaagtcaggaagacaaagcaagaactggaaatttgtgcagactgcttcccatttcaacaagactgtaaagcagctagattgggtttgacccacactgatgtaatgtagtaatgtggtctcacacaagttatttttcaagactaaataacccacatttggaaattgtactgcctgctccaccacagagcactcattttgggaaagccaaagaataagaccacatatcagagggtagggtttactgcaccatgttcccattgttaattttcctgggaacaggccatcatgacaaaggaaaagactgaaacagtagttcttagaagaggtgaaaggaaaaggtttttcttttatggcagtcagaaattaggggacttggctttggaaaggggcagcaggtttctgttgagaagtaaactgtttctgcagaattagagcaggctaattagatgtgggacagaaaacaaacatctgccacaataattaagccaggatatcagaaaaaggagctcagtaggatatacttaggaaagggcttcagcttacttactttgagacctgccagttgtccagtgttaagttatctgtgttgttatcagaatcaaacattaaaaacatacagcctattcttaccattgttttggagaactgagaaagggtcagcatgttggagaattgaggagactcaacagatcagatgagaaggctaatactctcatcatgggcagagggtttaaaagctgggaccaataattcaaactttcatatagtactttccacttcacaactgttggagcaacaaagttttgggagaactgctccatgacgaagcaccttcattaactcctttcacttggaattcctaaagagcatacctgttaccttctcagctacccagaagcacagaaaatcatttaaattcatcctaataccaatagaaatagaaatagagaatagtttttcctttactgtggtttgaatgtttgttctgttcaaaattcatgttgaaatttaattgccattgtaacagtattaagaggtgggacttttgagatgtgattaggccatgagggctctgcctacacgagccagcttaatgccattataataaggcaaatttgaaccccttttgcttctttgtccttttgtctccctccatctgatgatgcagcaaagtccttgccatatgccagatccttgatcttagacttcccagcctccagagctgtgagaaaataaatttatgttcgttataacttacccagtttcaggtactcttttatagcaggacaaaattaactatggcatccttcctcaacacaaagttaagaatcagaagattcttaacttccctttgtcttgcatctttatatttaggtcttgaataaatagcagtacatgaaaggaggaataaaaacactttttttttttttttgagaaaaaatcttgctctgtcacccaggctggagtgcagtggtgcaatctcgactcactgcaacctccgccttctgggctcaagcgattctcctgcctcagcctccctagtagctggcacatgccaccacgccctgctaattttttttgtatttttagtagagacagggttttgccatgttggcgaggctgttctctaactcctgacctcaggtgatccgcccgcctcggcctcccaaagtgcagggattacaggcatgagccactatgtctagcctaaaaagcactttttaaagaacttaatggcttctaactttcttcctgagccctaaatatccttgaagaaaaataataagctaaataataggattaaaaacattaattggagttttaaatgaagcttaaaacaggaaaagtatatatctttgctaaagaaaaaatttagttaataggtacaaagaagaggtttcaaatagaaatttaaaatgaaaattaacaaaaatataatttttcacctattagatagatcatttaaaaggttgataatgccaacattgctggtaggagtagattagcattgtatatcagattttaaatgagtggcaattttagcattgagaatgtagcctaaggaaataattggagaatccccaagaccaccttcaggttcagtaattcactgagaggactcacagggctcagcatatgttcatactcataatttattatagtgaaaaaatactaagcacaatcagcaaaaggaaaatgtgcatggggcaatgtccagggaaaaccaggcacaagctttcaaaagtcctcgcccagaggagtcacacaggatatgcttaatttccccggcaacaagttacaataacttatgtgaaacaccaaccacagaagctcttgagatactcaatgcccacggtttttactggggatggatcacataggcaacctttgcttggcatgtaccaaaattccagacacacaaggaaaataggtgttcagtaaaaaccatattgtttatacaaaaaggttaggcatagtgagctactattatcagttaataataggaacccttgcaaaatctgttaccagacatcaaccaaaagtcaaatttataagcaggcctttctaaggacaggaattcagtcctgttatattaactattttcaggaaggcacatatcaaaaataaatgttgaaaaatgttaatcagagcacttttaatactagtttttctaaaaactggggaaaaactatatttccattaataggtgcttattaaataacacattatgtctccataaaataaaaaaacaatagctctctcaaatgaatacaaacatgtattcatggctgggcatggtggctcacacctgtaatcccagcactttgacaggccaaggcaggtggatcacctgaggtcaggagtttgagaccaacctgaccaacgtggagaaacctcgtctctactaaaaaaatacaaaattagccaggtgtggcggcaggtgcctgtaatcccagctacttgggaggctgaggcagagaattgcttgaacccgggtggcagaggttgcagtgagctgagatcacaccattgcacacatgcctgggtaacaagagtaaaactccatctcaaaaaaaaattatatatattcattaacatataatattcaactttctacttctcatcttcatttatatattgaattagccatatatttattatatctaaaacccataattttcctccttaagccaccagcttcacccatactctgctccatctcagttttagccagtccattatttttgttgctcagactaaaaacagtagacaggttcctaattcctctatatttttcatatatcacatgcaatttatcagcaaatcctagtggatataccttcaaaatgtatccagaatctgaccacttctcctcatctcctttcctaccactatggtccaagacactgtcatgtactaggatgttattgcaatggtgtccaaggctccctctggttctatctttagtccttgtagcataaacttataggcctccaaccaatttgtttctctttttttcttttttaatttttttctttttttttttttgaggcagaatctcattctgtcacccaggctggagtgcggtggtgcgatcttgcctcactgcaacctcctcctcccaagtttaagctattctcctacctcagcctcctgagtagctgggactacaggcacgtgccaccatgcccagctaattttgtgtatttttagtagaggcagggtttcaccatgttagccaagatgatctcgatctcctgtccttgtgatctgcccgcctcggcctcccaaagtgctgggattacaggtgtgagctaccacacccggcccttttttttttttttcttaaaaaaaacttaggctgtacacatggtcatcacctcttcccccattagggactgtattttcagtctcacttgaagcaagttgtggctatatgattaagaaggatgggatgtgagcagaggtgaagtgtgcaacttttggttcatctctaatgtaaaaaacaagccatttgtcctagaaattctctcttcctcttttctgcaagatgtcatgatcctgtgaacacaagcaagataaaaacatgattgaaaggatagggaacaacaaaacatgtaatctggtccctgactgaccacatggaacagaaccacactaccaacatcccaagaagtaaaccttattcaagcctctgtaatttggcaggtctctttgtttcagcataactactgccatgaccccaatacactcctctgtatttattctcaaaacagtagtttatatgattctagttgaatcatgttagttgaatcatgttatttctctatgcaaaattcttgaatgaccattcagcttattcagaataaaagccaaggtcttaactaggtcccaggcaatcttgtcctcccaggtctgtttggccagtttctgttcatattctcccattccgctgtagccataggggtctgtttggcactctttgaaggtgccaggcactctcccatcccatcacagctcctttgcagttgccgttctctctgccggaaactctctttgtctagaaatccacaaagataactcccttaccaactctgagtttttcctcaaacattattttctcagtggaccttccctgaccaaccaacacttgcacactccatgtctttcctgtcttcctgttctctgtagcccctattgctttctaatatatactataacttacttatgatataatttatttatgtaatattactttcccttcaaaagtaagctgtatgaaggcaaaataattgattatgtttactgataatgtttctgacacatggaaaatgaataataaatgttttctgaataaacatgtcaataggaatgcttttgtctacaaataaaaaaaattaacagaagcttaaagcatataaatacacttattgttttttgtttttgtttttgtttgagacagagcttcactcttgttgcccagactggagtgcaatggctcgatcttggctcaccacaacctctgactcccgggttcaagcggttctcctgcctcagcctcccgagtagctgagattacaggcatgggccaccatgctgggctaattttgtatttttagtagaaacggggtttcttcatgttggtcaggctggtcttgaactcccaacctcaggtgatctgcccaccttggcctcccaaagttctgggattacaggcatgagccactgcgcctgccccacttattgtttatgttacaagaaaacctggttagtgtcacagattgtctacattaggtcatcactacagtgccaataatatttctctttattttcacaagatggctgctgtagctccaaacagtacgtcttcatacaatacaacctcaagaaattgaaggagggaaaaaaaatgctctcacatgtcttttttcaggatggtaaatctttcccagatgtcttccagtagacttcctcttaggtctcattgaccagagtggcattacactgtcatttctagacaaattactggcaagagagaaaggatagctataatttttatatacaccaatcaagatttatcccaggggctgaacaaaatgctatctaaacaaaattagaattctgttaacataaatgtaggagacatggttgttgggttggcagccaagagtctgcctgaatgacatacaaatgaatattgtttattgcaaaattataattatataataaggttaccttttataataggaattatttgaaggttatcttttaatgtttaatgtaattaaataggaaaaagcactccagaatgatagtgtatcagttaagattgcttttaattgcatgtaacagaaaccagattaaaatttaaatgcttaatcagaaaggtttttttccttataacaagaatttccactgtaggcagttcaggactgatcaaagggcttcatgatgccatgagggactcaggcttcattatgccagactgcatgcaatttttgtcttttgggccaaaaaaaaatgactgcactcctagcatatttgcacactatgtagacaagaggtggttgctaggcaagtcagccgccttcccaatagcgcgtactcagtgattcctgcttgcatctccttggccagaactggttctcagggccattgcttgtctggggaggtaagtattttagctagatccaaacaaaaatttggatctgttattaagaaataagaagagaatggatatttgataggcaagtagtgtctacaatttatgtttaccaaatatattaactgtgactaccattgagtggtgaaattataagtgattcttgtatcttattatattgcctgagttgttttcaaaatgtatgttcttttttaaaaaaaatttggaaataagcataataaagctatttcgatttggcaggggaaagtagaaagtttagagattttttcctatagactgcaccaaaatattcctgaccttaaaatgtctgctccaaatgatcatgtcaaaatattcttaccaaatatataactttggacatatactctcagagcctcagttaacttgtcaataaaataaggacattataactactcccaaagttattgtaaagtttaaatgagataatgtatataaaatatttagcacaaatgctcactatatggtagcttttattaatagtacttaagatcgagtgtagtggcttacagtactacccgcactttaagaagccgaggtggcaggatcacttgagctcaggagtttgcgaccagccgaggcaacatactgggacttcatctccactaaaaataaaaaaaaaattagccaggtgtagtggcacatacctgtagtcctagctactcaggaggctgaggtgggagaatcacttgagcccaggaggtcaagatggcagtgacctgtaatcgcaccactgcactccagcctggacgacagagcaagaccctgtctcactaaataaataaataaatacataaatacataaataaatagtacttagatacatggtagttgtaaaatagtctttaaattaactatatgttttattgactttacttagctatatctgttatattagctcatctttgagtatttactatgtaacagaaactgctaaatatcttacttatattgtcatgtaaacctcaaaataatctatgaaatagataaattattatctgtattatgcaaatggaaaaaaaaaactatggcttagggaggttaagcaaattgttcaagattatataaggcaaaatgtggcaaagcttaaatttagagctaggcagtttgacacaaatttttcattcttaaccaatctcctacaacatgaatctgaaagtcctctattttaacatcatgaaaaatcattagcctgcttataaatcaattcgtctaagaaattactttggctattttaatttgcaagtctagcagaaagaactgtagaatcagccgaaacacatccagaaattcaaaccttgtcattgcagcttttattaatgatggcaccccggttaatagttctgctttaaacaatttttataaattctcaaatagtatggattcatacattttataaaaatatatacaaatgcaaaattttcaagttaattcatttactaattacaatttggctaaatcagtctagaaaactaacaatgctatgaaaaaagtcaagtaatccataacaaaagagcaatataaatagacactctttctcagttattgtactggaataactagttgtattaactgcttgcatgacttcattcttaagtataaaattaataaaatgagagaagaataaaaaataatgaggttttagtttaaaaaatactaattgaaatcattagacaaatgatttataagttatcttagctgaatctaaaagaaatatatttctcagcaaaatacaattcagacaattttatagcaagtatctctctaaggttactgcaatttaccaacacaaataaattgagttctgtaaaagttaatgactgtctgatacttcctgctggctagaagaaaaggcagaatacaggagcaaatatattacaaaaaatgatttttaaaaaatgcttatgaggtacagcggtatgcagaagagtgaaagattatgtgcaggagtcaatcagaaaagctttacataggatatagcagaatacatctctgaaagataaatagaactttttcagataatttccacaaagaaaagcagtccaggcagagggaccaatataagcaaaagcatagagaatataaaataatgtggtgattttgaggaattgcatgttcttcaacactcctaaacataaattttgaggaaaaaatgacatgagctgttagagatgaagcaggtgattcacagaggatctttttggccatattgtagtttgagccttatccaaggtcattgggagagacactgaaaaatatatatcagtgaagtcatgtggtcatatggcattttaagtaatcatttttatcatactgatggaagacccttgcatcattatgatttttttttttgcttctagtagtacattttgcattaaaatatttttgatatagtatagctttaccagttttgttttggttagaatctgcatgttctagaatttttaaccattttaccttcatctttgcagcaaataattagaaaccttttcctcaatctaataatacatgtttttttcagatggagtctcgctctgtcgcacaggctggagtgcagtgggatgatctcggctcactgcaacctctgcctcccgggttcaagtgattctcctgccccagcctcctgagtagctgggattacaggcacgcaccaccatccctggttaatttttttatttttagtagagacagggtttcacatgttggccaggctggtctcaaactcctgacctcaggtgatccacccaccttggcctcctaaagtgctgagattacaggcataagccactgcacccggcctcaatctaaaaattttagtctgtaattggaatatttatccattaatatttaatgtaattttaccagtattattataatttattttttatttgtcccacctgttctatatttattttttctttccattcttttactctttggaattaatgaagtgattgttgctatttatttcccccttcccactatttgcttgttggttatatactttttcttatttcatgggttatgttaaagcagggtttatcaaccatgttacaagtgacattttggactgaataattctttcttgggtttggggagggccattctgtgtatattgtaagatttttagcaccattcatggattctacacattagataccactagcaccactctccctcccctaattataataataaaaaatgtcattagacatgaatgaatgtcccctgggggacaaaatgtcctctcttgagacccactgctctagatctgggatgttcaatatgttagccagtagtcacatgtgagaccttgacatgtggttagtataaattgagatatgttataaaaggtaaaaggctctagattttgaaaacttagtatgattgaaaaaaaacagaactttagaacacctcactttaactctgttaactattcctttcctctttttgtgctattgttgtcaagggatttttggtttggtttggtttagttttcagagacaaagtcttaccctgttactcacgctggagtgcagtggtgtgatcatagctcattgcaacctcaaactcctgagctcaagcaatccacttaagcctcctgagtagctaaaactacagacacgctgccatgtctggctaattttttctttctttctgtttatttttttttttttttttttttttttgtggaaatgggtgtctcgctttgctgcccaggctggtctccagctcctggccgcaagagatcctctcacctaggtttcccagttggattaggattacaggcatgaaccaccatacctgacctcaagtattctaattctataattatacatgccatttcacattaataatattgttctatatcgctaatattcacctacatttgaccttttacgttgctgtcttcactgcttcctgaattttcatgcttccatttggaatcattttctttctgattgaagaattccctttattattttttactgcatacctactattgattaattctctcaatttttgtttttcttaaagtctttcattacagctaagtgaatttttacatatgaacatattcacataaccacaacccagatcatggaatagtttcagcactatcaaaggctccctcatgcctcttctaatgaatacttccccaaaaggaatactatcctgacttctataaacattaattcgctttgccttcttttggcattcatataaacaggcttatacagtagccttttgtgcctagtttcttttgtacaacactatgtctatgaaatttgtccatttttgtagcatgtagcagtagttttctgaataatattacattgtatcaatacaccacagttggtttttccagtatcacattgctgtatcattgttcccagatgtatgtgattataaataaagctgctatgaactttcttgtacatgtatttggtgaacacaagcactcaatatactaggaataaaattgccgggtcacatggtaaactccttagtagatactgccgaacaatttccaaagttgttgtaccaatttacattcccatcagcaatggatgagagttctagtttctccacatcgtcacttaacagtttgggatagtaaggttttttattcttagcttttctggtgtataactgtcttttggaggatatgtattgtgaacatattcttctgatttttggcttttttttctccttgatgtcttaggctgaacataagtacttaatttttaaaaagtctaattttaaaattcctaaatgtaattttaaaaaacagactttctaatttttcaaagtctgtttgttctggttattatgttttgtttaagaaataatggcttatcccaagatcattaagacagtttcttataacttaatctagaaatcttatttaactttcacatttaggtctatgattcatcttcttttaattttgaaggacattttcgctagtttggaattctaaggcatttgctttcatttgtttacagaagctattctagtgtttgtcatttccattatttctgttgagaagtcatattgttgcttccttaaaaagactttttctttcttttgggtgcttctaagatttttctctgtgtttggttttcagcagtttgactgtaatgctcctagatatggttttctttgaatttatcctgaatggagttcataacccttctagattctgtgacctgatatcttccataacttttagaatatttgggtcaacatctctccaaatattgcttctgcttattctctttccttttcttctgggactcaaattacacgtacatcagaatgtgtcaccatgtcccacaattttcttatgctgttttccgcatgtctaacctctttttctcaccataattcaatctggatattcttttctgtcctttcttccagtttatttattctcttttaaaccatgtttaatctgctattaagcccgtttaccaaattcttgtttgagttactataatttttgcttctacagtttccacaaaatttttaatagactccagttttctattgaaattccttatcttttcatatttttttcttgaacatattaattgatagttattttaaagatcatagggccaggtgcatttgctcacatatgtaatcccaagactttgagaggccaaggtgagaggatcccttgaggccagaagtgtgagaccagcctaggtaacagagtgggaccctctctctacaaaaaaaatttaaaaattagctgggagtggtgatgagtgtctgtaatctcagctactctgaaagctgagacagtaggattacctgagcccaggaggtagaggctgcagtgagtcatgatcacaccactgcactccagcctgtgtgacagatcaagaccttgtctcaaaaataaaaaataaaaataaaagaagcccatgtgcaataaacacaatatgtggatctctatgtgtttgtttgcctgtttcttttgttgtttgtttgttttgatacagaatctcactctgttgctcagtggcacaatctcagctcactgcaacctctgcctcctgggttcaagcgattcttctgcctcagcctcctgagtagctgggattacaggtgcacaccaccatgcccggccaattttgtatttttagtagaggcggggtttcgccatgttggtcaggctggtctcgaactcctcaccttgtgatctgcccgccttggcctccccaagtgttgggattacaggcgtgaaccactgtgcccggccacctgtttctttttatatatttatttatttgagaccacgggcatgtgccaccatactcagctaatttatttttttcagaggtggggtcttcctatgttgcccatgctggtcttgaactcctggcctcaaatgatcctcctgcctctgctccccaaagtgctggggttacaggtatgaggcatcataactggccggtttttgtttttttcttgtgatgtggtcatttattctgtgtcctggtatgcctacaattttctactaaatattgggcattgtgtatgaaaagttgtagtaataacttgaagctttcaatgatgttttctttctctggagattactttttatttttctggtaggcagtcaaatagagctagatcacctgaatatattctgtgatggtactgattcaaagctaagtttcttttttaaaaattaaacttaatttaatttaatttttttgtagagacatggtcttgatatgttgcccaggctggtctcaagctcctggcctcaggcaatcctcccacctctacatcccaaagtgctgggattacaggcatgagccaccatgcccagcctaacagctgagttttagtctttgcaatggctctgtattttcagtttacaccactcctaggattatccttccataggtttcactaaaaaatctggagtgtttacaagagtcatttgccttggatggatgctgaactccaaattttgtctccccagtatcataagactgataaaaattctgcttaatgaatctcttggtcaatgctttctgtttgatttcttttttttctttctttctttttgagacagagtttcactcttgttgcccaggctgcagtgtaatgacatgatctcggctcactgcaacctccacctccagggttcaagtgattctcctgcctcagcttcctgagtagctgggattacaggcatgcgccaccatgcccagctaattttgtatttttagtagagatggggtttctccatgttggtcaggctggtcttgactcctgacctcaggtgatccgcctgccttggcctcccaaagggctaggattacatgcgtaagccaccgtgcctggctttctgtttaatttctaatcccctcattctataccacccacaatcagcaaattccttgaggggataaataacaaagactgttaggatcatctcaatttctgtgtcttctttccaagatcttggttgatgggttcctagttcccagttgcctagttctctgatattttcaaaccaaatttttttatttcattcagtttcttttaaagctgttgttgacattgggggtaggtctgataaaagctagtctatttgcttaaaagagaattaccaagacgatatcaagatacctagtgttagaaataaatgcttgttccttggtgccaaaaagaagaactagcgctcaaagaattttctcagcaaggcaattttactttctgcagaaagggtgctttttggaagcctgattgtcacgagagcaccttgaacaaagaaaagcagaggtttttattcctgacgcattgggtccttactgctgtgtcctatctccattggctggagctggactgcacaatctagactgatcccgattagctaaaaacttaaaactttcctaaacaggcaaatgtgcgacagagaacaaggaaaggaagggggttgtttatgggaaactaggagaacaataacatttccaaataaggaaggggcgtaggctgtaagccaggaaatgcctgggcatgttcagatacgtctgagcaggttataggccagaataaataacttggttgaagtacaaggacatagaatgtacttattcccttactatatgtaacagctacacagggcttagcaaagagttattagcaaaaagcaaggaagcttgaaggaagttagtttttaaaagaaactattatttctaacacttatttattctttaacgaaaagggaaactttgaagaggaactttttacttttcacaacagtgacagagccttctgggtataattgttcctaattgtgcagtttatgcaaatagagatgacaaaaaatattttattggccactttaggacaaattgctaaagagaccacaaaacacattgcagcacaacaaaagtctctaaattccttagctttaatgttttagcaaaatgtatatgttttatatagctaattgctacaaatctaactaaaaccaagattacagtagctcaatgcatagactttatagataagtcaactttgtaatcctgcttttgggtttagtttttgactcctgtgttgcttaaaaggttttaagggttcatgagtgcctgtccacctccattcccttctagcctagaatgtctaatttgctgtaaatcttttagctctaagtcccttgaacttccaggccactgagggacagactggaaccaggataggtagccacaccaccctggcaacaatatgggaaaaaataaattttagctgtagatgctgcctctagcaaatctcagacaaagggggaaaatgagaaataaaaataaaattctaaccccccaacagactgaacagacgatctcttggccaagaagacaccagagtaaccttgaaaactgagttctcagccatgatagtattggaggtcagacacacctccttataccttatctccctcactaaccaccattagccttttcttccctaaggggtaaacaaaaaccagccctttcaaaaggctgcaccactgatctcaaacaacctcctgagattgcccttcttttttgcttaagagaccacagactaagaagtggttctggccagtctttgaagaatgtgagaatgtgtagtaagggattttatgtcctctgcctcactttttgacatcacagggcggaaaactccacccttgagttatgctaacatcgccatcttttaaacatgttacccatgaagatgaatgaagctcaactgcgcatgtgcgtttctccttttataaatattcatgagtccaataacttattgaatacgtatattcagccacctagttcgggcatgaattcccgttcccttttcccctccctccaagtgttggtttttgcctggaggctgtgcatgtttcccagcctattagaatggccaccctgccagctacaatcttttatgagaaataaagctctcctttcaaaattaaaaacaacaacaaacacaagatgattctgcctggtcagaagtaaaaaatcctctagacctatctctgtgcaggatgtctgtgaagaagaggaaaccagaaaagaagagctactatagagataatgaaaatatgaactactaaactttcttccatttcagattaaaaaaaaaatagaaaaataagagacacatttggagggtagaattattagaatttagtgattggatatgtaagaaagatgtgaaagagaggagagaaatcaaagatgcttagataatggatagtggccgcactagctgaacaaggcatgcagaaaataaaaagggattaagagggtcacaaggccaggtgcagtggctcacacctgtaatcctagaactttgagaggccaaggtgagaggaccactggggcccggagttcaagaccagcctggacaacatggtgaaaccccgtctctataaaaaatacaaaaaaatagttaggggtggtggcacacacctgtaatcccagctatttgggaggctgaggtgggagtatcgcctgagcctgggaggttgaggctgcagtgagctgagactgggctactgcactccaacctgggcaacagaataagaccctctctcaaaaaaaaaaaaaaaaaaaaagaggggttcacaatcaaaaaggatgtggtcaagggggaagggataatgaattctggtttaatcatgcttaaggtgtctgtggatctttaagcagagatgatcattaagcaactggattggggggagagatttgggctactgaaacagagttgtaagttatctgaatataagtggtggttaaaattataaagtcagatgcaatcatgcaggtagcgttctgtaagtagaatatgagaacaagccttggacacacctctgagaaactcaaatatttaagaggaaggagatatataaatatcagtttagaatcaatctcaattaattatatagaaaaatggtaagtagtccaatttttaaaaattattccatgaaaaataattacttgggcatattaggtcctttatgatgtttaacaaattagtatttttataggtccataagacagtcattagtcatgtatttccacaaagatgtatatatctggaacatacagcagaaacaccagaaggatataaatgaaacaaaggtaatatacgtaatttcaggctggagttggtctggtattactgatttagggagtaggctccgaagtaccagctgtagaatcctactgcccacatttgtaacctaccttttctacttcctagttgtgtgatactagggaagatgcttaatctctcaaagctccaattttattatttatacaataaaaataaaaacaatacctattccattgggttgctatgacaatgaaatgaaataatgtgtgtaaagttcttggcatagtgtctggcatataataaactatcaataaatatgaaaagttatatagcttcagaccagctaaattacactaaagtaaaattaatacgaacatttaaatcactattgaattcaagttttaaacaccttttacctatgtttaaatggcagagtaaatctagttgtaatatttttcattcttttgattaccaacactgattcaacctggaatattttctttctctatatgttgccccccaaaataaaaataaatgcaaacttcccacatagaaataaaccgtctttttgtcaaagtaaatatgtacctgtgttcctttgcttgaattgcttttgcacatataactaaagtaataaatgccttccaaactagataaaagttgtattatctgaagtgacttattaatgtaaaactgtatcctgtatttaccatgtgttgggctgcaatcaatcatgctacctaaagatctacataactctcctttttaaattccacatcagtcaaatatttctgggaaatgaattctcctaaaccaagaacaaaatttgtatttggccaagataccaacttcactcttgaagtcagtgattcttaatgattcacaaggtaagtgcttgctattttatccaaagacaataagcaagttcaattcagtactaactgaaacattgactttactttctcttgcctttagaaatctttttagcatttttcatttctaatactgtctccatctgaatgttcttagtttgaatgtactaatgcattcagaaaacattcttttttcaattaatccattttacttgtgtgcaagggagagaagaaaattgtttgctttatactctcattttcctcatatatatatatatatatttttttcaccctctcttatggtgatgatccttatattttacaaattggaaactttgaaaatgaaatagttaccttgtgctgtcaagactctttttgttctaggtagtggaaatataatacaaattacttgtcccttaaaagaaatgtataggccaactaactgcaatatgcagagacggtgctagctcagacacaactaaatcaagggtttcaaaccacagtatcatcactataattattatcatatttattgttctctctgtgcctctttctcttactgttctgggaagaagaggtattggtcttcttgttgctgctataataaatgaccacaaccttagtgacttaaaacagcaaaaatttattctcttaaagttccagaagtcagaagtccaaaatgagctttacagggctaaaacttgagatgtgggcagggctggtttcttctggaggttctaggggagaatctatttcttgacttctccatggtctagaggctgccagcatttcttggtttgtggcagcatcattcctgtctctgcttccatggtcatgttgccttcaactaactctgatctcctatttctcttttgtcaggactcctacgattatatcaagcacaccccaaatgaaatatccagataattcaagacaatctgttcatctccagattctcaatttaatcatatctaaaaaatctgttttatggtgtaaggtcacatattcacaggttctagggattcagatatcaacatatttggggaggtgattattcagccaaacacagagggtctcttagaacactaactttagcaaaagtaccaggaagaattcttattggcccagcttgggtaatatgcccatccccaagacaatcactatggccaagggggtgatgttgatggtcagacagcctaatctgcatgaccactcctgaaggatgtaatgagaatgctgtgacaacggtcccactgggtctatatgtatttggagagggatggctttccaaaggaagagttgctattaccagaagaataaagaagggattatgagcagactcccctctcccctcaccaaaaaaaaaaaaaaaaaaaaaaaaacccgcacaaaaagcagaggcacactacgaattcccattagaacaacactgtcaatactctggtaataataacagaactgttcttatttgaaaattccatgtatgaggatgtatacctgtctatatgtttttggtttggaccaaaaaagcaacgaataagaatgcgagatttaaggtcagacagacctggatttatagcctgactctaccctttctagctgtgtaacattttagacatgttattgaaatttcctgattttcagatgcctcacaggtaaaataaagttgcttactatattggacacggatatttgtcatgttttctgactacccagcatattttgaaaacaattttaccatactggaaaatcctcagtctttagagtcccgcttccacaaagtagaatgcagaaaactgaattctcagcctctcttactgctgggcctaggaatatgacagtgactttgacttctcctgtgagattcacacatgtaagaatttgacaggtaagtaacggagtttatgtggactgttttaaaatcttgcatacaagaagaaggctccagtcagaatccatttttctggtacagtggacaacaatgctgccgtcttgtggtggtagcaacaacactgtatgcagtttagtttctcagtgatttcaaggtcaagttccaggcacagatgtggcccaggcagggagttgagagttggcaacaccttccctagtgctctgtgggacagcaagagaagcagcagtttcctctccgcgccaactttgccatgtgattttcagaattgttcctaggagcttaacttcaagtctagctctccaggcctccaaatgcttctgtgagctaaccaatagtctttttttcaaaactcccttttctgcttcatcggctaaagagagtttgcttcagttaagtaatattaacagtgatgaggccgggcgtggtggctcacagctgtaatcccagcactttgggaggccgaggcaggtggatcacaaggtcaggagatcgagaccatcctggctaacacggtgaaaccccatctctactaaaaatagaaaaaattagccaggcgtggtggcaggcgcctgtagtcccagctactcgggaggctgaggcaggagaatgacgtgaacccgggaggcggagcttgcagtgagccgaggtcacgccactgcactccagcctgggcgacagagccagactccatctcaaaaaaaaaaaaaaaaaaaaaaaaaaaaaagtgatcactatatatttatctcagagagtgatgttgcaattaaacaaaataagatattgttatgcaaaaaaggaccaatggccagtcagtacacataccagatctgctagagcaaaatttactggggaaaattcatgaagacaggagcagtaacaagcatgcagtcccctgttgcattgtaaagtggaacacagagtgctagcatggtctaatgtcacattctgggatagggcccctaatccccggtgtgcggacttttgcctgtttggaagcattgtctcctactctcaggcgatcagggaccaggatactataacaagatgacattgcaaaactttggctccagccctagtctgtgaactcagctttcatatttgcagcaaacatgagcccttcccctggcataatcaggagcctaagggcaggtcttatggttgaccaggattcactgcctcgatgtttggctgtggccagttttcatacagctttgtagaaggtcaattccttttctttttttggaggccacaggggaatcatatttgggcaagttaattcttacctcctggactgggttgaatagtgttcccccaaaattcatgtctacctggagtttcagaatgtgtccttatttgaaaatagggtcaggccaggcacggtggctcatgcctgtaatcccagcactttgggaggtcagggcaggtggatcatgaggtcaggagttcaagaccagcctggccaatatggtgaaacccccgtctctactaaaactacaagaaaattagctgggcgtggtggcgcgcacctgtagtcccagctgcttgggaggctgaggcaggagaattgcttgaacctgggaggcagagggtgcagtaagctgagatcgtgccactgcactccaacctgggtgacagagtgagactctgtctcaaaaaaaaaaaaaagaaaaagaaaaagaaaatagggtctgtgcagatgtaatcaacttatgaataggtcacctgtaggagacagtttcaacatgctgacagcttaccacctcaaatgttgtgtgtctcttctctgccttagggttttttctgggactaactgtgggagtctgctccacccaagtcactcaaagcaacaacaatcaatatgagtttgaagtagatggataaatgccccaagctttctagcctcccacaggacagttttaaagcatttgagagactctctctctctctctctctatatatatatatagacaatggccagaccatatatgaaaatagaactctgacctacaatctgtagcaagcaccctaggaaatcataccatatctacagaaagctaggatattatctgtaagtcagatttgtaggaagtcagaccactatctccagaaatcagtccagtaagtcaagcaataatccctataacaattggcccaaaatggccaggactcgattaataactgacagcttccctaatttttgtcccagcttccaaattaggaccagccagagaaagccaaatatgcaccccaatcaatcacacagaaagccccaaatctgtttagcctacctatagctttcttaagccaacagcttcaaatcagggcatacctgaaaccttctctttttaccactataaagctttccactcctatgcctgcctctaccaaacacaagtgatgagtctctaccaaaacacaagtgatgatgcctgactctcttgctatatcaaggtctgaatatatgctttgtctgttctcatttggtcttcatttatttccatatatggcatacacactttctctggggatcccaacaaaattaagccccagttgcccactactgtactttgctcattcatgcactttttattggctttccctgcttctctatcttggtttggtttcctcaatttgcctgccatgaggaattatctcctgaatataccatctgcacctaagctcttgtttcagggtctgtttttgaggaaatacaatgaaaatagaccatattaatggaagcacaattttaagaatattatatattaaccttgaatatttcccataaaaagaggcatttaaaactaaaattccaaagtgactgcatcaaccattgttttcttctagtcaaaatgttaaaatactgaatattactttttaaatgttggtattattccaatggctttctatgccattaatgtatttggcatatgttttttattttctaaaaaatgttggcaaaattccctaaagggaatagtcatttaaattttttttttaatttttatttatcccacatgttagatatgagttctaaatttcttttcaaagaatcaatatatcagtatgttcagttctttgccttctacttttaaacttaacttccacataaagcaaccttttttgattacctgctccaccctgactcatttcaatcacctgccccaccttgactcattccgattacctgctacctgctctgccctaactcattctctactctgcataaccgtttttcccgccaaaccatgcaccccatcactgtctttaaattagccagttggaattagtttagcctgtgcggcctaacccgagccaataggggaatgacacagcagcaggggccacatgcgtcaggcataagaaccccttccctcccttgtccaagtgtgcgctcaccattgctccatctgtaagggtgcacccttctatagaagtaccttgccttgctgagaattaaaagaaaattttatattcaagtgctatttcttttgcggcaccgaaactttatttataacacacaggtaaaggtttaatgtgtgactgtactaaaaataggactgaaatttgagaatgcatttaaaggagaaacaataatattcaataatattctactggttggaatatagcttataagaaaagctaattacatttacagagtagttgaaaatcttggacttagaatatatgaatgatattcatttgaataaattaagagaattgaagcatctttcttgcaaagtgatccagttacatttagtgagggaatattcatgtttaggctcagtgtctctggaaacctaaaaaaactagagcacatttgccctgcaggctctaacttggaaattcaattacgatttattgataaaaagactgcaccagtgaaaatatgttatcctaatttaggaatcaataagcatttctgtgatttttatgcactacaaattatatactttaatttatgcctatctgatgtccaagtatgttggtaaatgagatgcctaaaacaacatgtggagttagaatataattatgttaatgctaaaaaaaggtggcatttgtattctaaccataacagagcttatgtggactgttttaaaaacttgagcactaggcccattacagtttcatagtgtcccttctgtctgtcatcttttacacctggctgatcctcccacacaccataaagacaaagtgaaagcaccaagagaagttttaggcaattacctccacagatttccatttctctctctcgaaactctcatctccgtctggcctgctctgatttttgatggcctgcatgtgtaatagagttccaagtgaggctgaatttagaacgctgagtgacaagctggcagcatgtactgctttacgtacctgtagcctatcctcttggagattttctctcttttgctcttagttgtgtaagatgttaggcacctgttctcttggggggaagtctcataacctgatgtttgtcaagatttcttggtatgcagagcttgcctctagggtagggtgtggaaaatttgcatactaatgaaggagccacttggagaaaaaaatgagtgaagatctgaacaactaacttcccttttgaggtttaacgtcgttagaaaatttctgacagattgaggtggttctgctcaagatttttaattggaaaatggcatcaaaggttttgaaatagaagtctccctcagtgctttgggcttaagacccatccaactcacgaacctagccatctagaataagcagttttggttaaagcacatgtgagaagtgagaagttcctaagctacttcaattcctaagaaactagcacatagtcagttttggagatccaaggctaaacgtgtgtctgtataaacttgaaaccaaactatggtataactgtacagtgctgaagagatctgaacaaagaaaggatatcattgcagcagtaataaataggcgttccttagactgcaaaacaagtgcttggtagaaaaaccaagtacaataacagaaaacctctgatgctaaaggccttcatataattttcagttctctttcttcacttctttttatgaatagttttttgtggggaggccacagtaggcagacattgacgtttctgcaaatacaagaatgagattgctaatagatatagaccaaactggtaaataaaagttgtggtttccagatctgctcagttttagagtttcggcagactccctgtattcttgtgtctctgagtataagctgcgtatattgcaaaacttagataagagttctgttgattccgtgggagcataaaaattgagcagaaaaatagagttaatttattttttaaaaatccacataactcaaagtattagaaaacaaaatgaattaaaacatagaaatcagtatgtagatttacaatgtagcctggtttggccaggggcagtggctcacgcctgtaatcccagcagtttgggaagccaaggtgggtggatcacctgaggtcaggagttcgggaccagcctgaccaacacggagaaaccgcatctctactaaaaatataaaattagccgggcatggtggcgcattcctgtaatcccagctactcgggaggcagagacaggagaatcgcttgcaactggcaggtggaggttgcgttgatccaagatcacgccatcgcactccagcctgggcaacaagagcgaaactgcgtctcaaaaaaaaaaaaaaaaaaaaaaaaaaaaacccaaaacacaacaatgtagcctgttttacaagtctcaaagtatttcggtggccagtaggaagttggctaactgggaaagatgctgagatacaagattggctgaatggtaagataaggcattcttagttttggaatggggaactgggaagtaagatgagatctagacccaaaaaaaaaatcaaatatagccagaaacgtaaactgatgtcttaactctgtgcttttaaatcagtttcacacttctattccatatgtgcctggtacccagtttaaaaaaaaagaaaaaaaaaaccctctggacaaaaatgtgttggaaaataaaatgaaagaaagcatcccatttacaaaatcagatttcataattaaaatacttaggagtaaaaactgagaatctacttggagaaaaaattagggaatttttaaaactttaaataaatggagatatgctttgatctggtatagaaagaccaatcttataaacatgaaaattctcccaaagtttaataagttgattcagtgtaatccctaacaaaattccaaagagttgtcttcttttattttttgatttgcaaaaataatactagagctcacctataaaaataaatgtgtgaataaagacagaaaatttcttaaaaagaaaattaatatggggaaaatatttctatcaggtattaatatgtgtagagctttaatattaatgaatgttattaatagccaaagaacaggcagatttgtgaaactaaagcattcagaagtaagcccaaaaacaaataggaattcagtgcattaataaatatatctccttaaattactgagagaaaatcagttgttcaacagaccaatattgaaaaactgggcatgaatcccagatatgtaaatatttgattgtaaaaatgaaataataagagaacttaaagaaaaaacagagaattttttttttacaaccttagactaggaggcttttaacaggaagactgaaaatccgaagtcactaaggaatagtttacatttgactgcataaaaactaagatctcctgtaagactaagtgcctgtaagaaaaagagaatcttactacaaagacaaaatacaacaaaccacctgaagaaaacattatttgcaacatatgacaataaaatcttaatttctttaatatacaaataagacttgctaatcaataagaaaaaaggcaatcaaatagacaaaataaatggcatggtctatagacctgtagatcaatttaaaatacttacttcactaagaaatgaggcaggcacagaaaaagtctccttcatgagtcttaattctagtaggaaggctaacagttagctggtgaatacttgtatagccatactagttgcttatgacttgtgcttactcttattggtcaatgcccacaccccttttagttgttaaatattttaggtatcgtcactgctggcagagtgtaggcagacaataaaccaataagaatgtatagcagagtttctcaacctctgcagtattgacatttaagaatggataattctttgtgtgagaggctgtcctgtgcattgtaggatgtttaacagcatccctggtctctacccactagatgcccatggtagcaatcaccctccccacttgtgaaaaccaaacatatttttagatattgccaaatacctctctcccctgttgacaaccactgatatatggataacatttcaggtagagtgttatgaagaagaataaaggtgggtgagaagagacagaatgagggaggcataggcaactttcagtgggatggtaaggtaagagctctctgaaaagttggcaccaagcagtgagctgaagtgagtgagccacgctgctacagagggaaaagaattccaggcggagggaacatcaaaagcaaagaacctgagacatgaacatgtctgacatgcttgatgaatagtgagaaaaccagtatagttggagcagagggaaaaggagtgggattgaaagataaggtcagagaggacgtcaggagccagtcttttagggtcttgtagaacacagtaagaactatgaacattactttggataaaatggaaaaccataggagggttttgagagaagatggatgtggtctatcttattcctctattttaaaaaaggaataaaaatagctgagaatcttattaaaaaataatcaaccagttgcaattaattcgaaagacttttaaaaattgatataccacctttctcacttaggacattagcaaagaattggaagttgaaatacccagtcatggggaaactttcgggaaacaggcacattcctctgcattaatggatgtaaattggtacaatttctttgaaggacaaattgtcaatatctatctctctctctatctctctctctctctctctctctctctctatctatctatctatcatctatcatctatctagtttttttgttgttattgacaaggtctcactccgtcaccaatgctggagtgcagtagtgtgatcacggctcactgcagcctcaacttctccgggttcaggtggttctcctacctcagcctcccaagtagctggaactatagtcatgtgccaccatgcctggctaatttttgtattttttgtagagagagggtttcactatgttgcccaggctagtctcaaattcctggcctcaaaccatccccctgaccttggcgaccaaaagtgctggcattaatggcatcagccaccccaggcccagacaatttttttttctttgaaacagggtctcactccagctcaggctggaatgcagtggtgtgatcatggctcactgcagctgcaacctcctgggctcaagcaatccttccaccttagcctcctgagtagctgggaccataggcatgcaacaccatacctggctaattttttattttctgtagagacagggtctcactatgttgcctaggctggtcttgacctcctgggtttaagaaatcctcccacctaggcctcccaagtgttgagattacaggcatgagccaccacaccaggcctgttagaatttaaaattttaagtgttaaaatggacacagtaggccagcagggcgcagaggttcatgcctgtaatcccagcactttgggaggccaaggtaggaggatcatttgagcccaggaggtggaggttgcagtgagccgagatccagccactgcattccagcccaggtgacagagcaggaccctgtcttaaaaaaaaaaaaattgatacagtaattacatttaaaaggaacttatacagatacactcacacaaatgtgcaaaaaaaaaatatttattgcaacattgtttgaaagcaaaaattgcaattagctcagtgttcactaatattgaactggttgtagaaattacagcaaatctgtataatagaaatggttcagtaatcaagaactttaagataaatctatataggctgatatggaattctccaaaaaaaatattgttaaagaaaataaagcttggtacaaaagcagctaacagcatgattccattgttatttaaaagaatttaaaaggcacatgcatgtttgctttaaggatattcaatgtctttctatctggtttcaattaactggtttgttccctataattttcattgaccataataaaaaatgactagtaatgaatgctccattttgtttggattttgattctcaggactatgcttattttgtagatttttactggggaacttttcgtgggtttttttttgttttgttctgttttttgttttgtttgtttgttgaggtattacctgacttacatttacactttaatataacttcatcataaatataataatttttaaagtaaaaattccatatttccatgtggatagaaaattcctgggaggatatgtaagaaactagtaacaatgatttggagagtggaagtagaagtgagacgggggtgggggacttcacatttcatttcatagctctatgtacttgtttaattttttatcatgtgcatattttctataaaattaataatttaaattaaaacgagagaatcttcctgaataccagtgccatcatataagtgatccctacactagtggccctgaacttttgtccccaggcctgtctcctattcctggcctaggattatctcttgaaaaggataacaaatttggttttcttggtttttattttcagttctctgagactccacttgctttcactctggctcctgttcctcctacttcaggtaaccattgcataatctaacccgtagtccatctgtctgcttaactagcacccaaacctggccttccataaaagggagtaagataaaactttcataaaactgcccaatacaggcaacactgtcatgcaggaaatgctactgtaatattttatggaaatagacttcattaagatgctcaataactgcattacatccaatttagaattggtggtagttgtcacgtttttgtttttgtttttgtgtttgtttttgtttttgtttttgagacagggtctctttctctcacccaggctggagtacagtagtacaaacatagctaattgtagccttgacgtcctgggctcaagtgatcctcctgcctcagcctcctgtgtagctgggattacaggtgcatgccaccatgtctggctaattttttaaatttttttgtagagacagggtctcactttgttgcccaggctggtcttgaactcctgagctcaagagatcctcccacctcagccctaaagtgctaggattacaggtgttagccactgtgccaggccatgtttttgttgtggaatggtaatattattatggattttatatgctttaaggctgtgtgagcagatgcacgcttagttcagatttacgccatataacatgcattattgcaaaatagtagctgaagttggtaatttttttcttactggtcttcaatgggcccatttttggtgcaaccctggtcagagaatatatgggaatgttgtttcgcatagacttggggtcatatgtagtttgcaagggagagtttcttatttgtctcttacccacccctcattcccgtggttggttttctttcaccatttttatacactactttcctgaccattacttccacctcctaagtctagcgtgagtacttttcatctctgctactgtgataggttaccctgagttgttaacatgtagccaataataaatgatgacattcccgacattttcacaaggaataaaacaatgtatataggtgtacatgtcaatttttgatgtccaaactcatttcatgctttttctaacctttattttttgccattatttctaacatctatttctgggcaaagttttctagatgaaaacttcctgatttgttgacattttctggttgaataactgccagattctcatttggcctttatgcttcattcagctccaagtggataaacactaacaaggaaagaaaacagatattcagaaccagcctaactaacatacgggttttttttttcctactctgccaatgtcactagtattattgcagcttcaattaataaatgtggattgttgcagccaaaacacaattattatttttccagcaattgtattaaaacagtattaaaatgattattcaggtacccaactctttaaggacagatgggattctatataactgtctgaaaagctaatttggcaaaatgatatttgttattttaattacagaattggagaggtattaccatggaaaacaaattctccatttggctgagtccagagctttcaagaaggaaaagattgctatggtgatcattattgtggtttgctggctatcgtcagataatagcattccagatgagcaaggcacctagtgatcagcaatttttgccttcggtttttgaacatttgggcagaccttagcaatgccttctctactccatgatctgctctttcattatttctttctattgcagaatcctgttttgcctgagtatgtccaggttcttcacagaattctcctaccttttatactttttaaatgttaaaaattaaaaatattaaaaaataataaataaaataaaatatgttaatggacctgaacagataggtgactaatacatgttgtattcctccagcaaatatcttaacttcagataatgtgttagctccctattttgtcaattttgtaagtgtgaagtttcatttattaagtaatgaatgatatctactatgagtaacatttcatatataataaacctcactattaatatagaaagtatggattattagcaacagtatattaattaatactcaattagcctggagtctctctgagcctactctggctcaggatgctgcctgataaaaaaaaaaaaaagaaagaaaaaacttcagctagaaggactgcaaatattttttaatgtgaagacctgttttcatctgagatgtaaaaggaaaagactgaaattttactggttagtataatgatcattggaaagtgacaataatgctttcaaaattatgattagatgagaaatcaaaatgtttttaatgtttttaaaataagggttttttttagacgggctctcactctgttgcccaagctgaagtgcagtggcatgatcatggctcactgcaacctcaactttccgggctcaggtgatcatcctacctcagcctccctagtagctggggctacaggtatgtgccatcacaccgggctaatttttgtgggtttttttgttttgttttgttttgtttttgagacggagtctctcactgtcactcgggctggagtgcaatggtgcgatctcggctcactacaacctctgcctcccaggttcaagcaattctccttgcctcagcctcccaagtagctgggtttacaggcgtccaccaccacgcccagctaatttttttgtatttttagtagagacggggtttcactatgttggccaggctggtctcgaactcctgaccttgtgatctgtctgcctcagcctcccaaagtgctgggattacaggtgtgagccactgcacccagccaatttttgtatttttttttttagatggggttttaccatgttggttagcctggtcttgaactcctggattgaagcaatcctcccacctcaccctcccaaagtgctaggattacaggtatgagccatcacacctggcctaaaaataagttcttgaagttaagctacaatatgcaatttggatgggaagtttcttgaaatctaatttttttttttttttttgagacggagtctggctctgtcgcccaggctggagtgcagtggcgcgatctcggctcaccgcaagctccacctcccaggttcacgccattctctgcctcagcctcctgagtagctgggactaggcgcctgccaccacacccagctaattttttgtatttttagtagagacggggtttctccgtgttagccaggacggtcttgatctcctgacctcgtgatacacccgcctcggcctcccaaagtgctgggattacaggcgtgagccaccgcgcccagccttgaaatctaattttaattaatgttttgtcatcactatattttgtgatcaaatgaaataattgatgtggccgggcatagttacacacacgtgtaatcccagctacagtgaggctgagtgagctatgattgtgccactgaactccagcctgggcaacagagccagaccttgtctctaaaaataataataataataattgattactactaataaatatgtaactgacagttttttgcttctttaataactatatcatattatcagctctcacaaagaacaattactttcattacattgttttcttttcaaatgtctttataaaacgggttctctaaagctataaatgaataaataattttaagccaggtcttctttcttaactcaggtatgttctttttagaacttcctttgaagggatgacaggccaaaagatggaaatgggaagcaatagagggaaatcaaaatttcactgctgctatttaacattattgtgaagtcaattcaccaacttcaaaagaacagtgataggaactggcaaaaaaaaaagagatcagacagaataagtaaacagaggtttgaatgaaagactgagaaacttggatttaattctacaagtaaaaggaagtcagtgagagtttctgaccagagaactgacaaaataaaaaaattatttttgcaaagattaatctgcaactctgtcatgaataaacaggagtcaagagatggaaaacaaaattaatataggaatctgattatagttattctagccagaggtcctgaacacctggagtaaagtggttattatgcagaaggcagatagtatttaaggaatgttataaagaaggaatgggcaaagcttttggactgattgatatgggtaacaaatgatagggacagataaaaaggactccctgattctgggcttattagggtagcaaagtcaacaaatattttttatgtaaggacatctttttgagaaattcatagccacctacaagatcatagtcgtaatttaaaaatccaatgatggagaaaaatatttaacaaataattgctattaactcaataatgcttttagatgaatatatatttataaataacatccgctatatgtctgttcacactgtgcactgtttgactcttctgcatattgacactgatataaatgtcaattatagcacaacctagagttgtgcagtatacaacctaccctactgtacacagtagtcatggactgtagcatctatatatctctgaaaacagttgagcaaaacttatggaaaccccacttattcagtcctcagatattatctagttcaagatgacttcagggatgttttctaaagactctataattcacaagggacagtcatctatatatcagataacaataagaggaggaaaaacaagaggactatattgctgtgaacagtgatgggaaagttcatagaaagaagagttcttcttccttacaaaatccctgagcctctctgctttctaagataaagtaggggctaagaatgatctactctactatattagtttcctagggttgctgtaacattaccacaaaccttgtggcttaaaacaacataaatttattttcttacagttttggaggctagaattccaaaaccaaggtgtcaacaggccatgtcttttctggaggttctagggaagaacccttgcttgcctctcccagcttctggtgactttcagcaatccatggcattctttggcttgtagctgcatcactccaatctctgccttcctctttacataggtttcttctctgtgtctttatgcatattcaccttttcttataaaatcacctatcattggatttaagacccatcctaatccagtatgatctggtcttgggatccttcactaattacatctgcaaagaccctttcaaataaggttacattttgaggttctgggtgaacacaaatgtggggggaacattatctaatctactacatatatctatgtgaaaaacctaaatattttgcaggccatgctctcaagtcttttaaagaaaatgctacctcttacagttgctgagttttacaaaggtaaagatgcaatatgttcagattctaaagctcaaataaaaaaataacagcctcaagaccacaatgggtgtgggttacagcaaaaatgctttggttgaacaaagcagcacagggcatcaaagaaaagtcaatgtctccaagctcctgctttaacctcttgagaacatagccttcccttgagtaatgactttcacattcattgttttgatgtactttttcctacttgtgataaagtcctgcttttatttcattatgaaagaagaaaatgaaggaaagaagataggatacaattccatgggcatgttatctgactcttttcataaaacaaaaaccttttattttgttgttaattgatgtttaaattgtacagttagttattatcttgatttttcctttcttaatctagttttgtatattcattcattgaagcataattggaatattttatctaaaacattatgattgtttattaatatagaatagaataggtgagacttttaaaatattagtttataattctttttgaagtttgtatagaatggtgaatttttaaaaattcatcacgatgttttttcctaacatgaattatttatcgtttgcataaaaaagaggtaattttataaaactatctttcttattattctttgttgctttcacattttcacatagcaaattaaaggaaaaattacattattgcaggaattcagtaaccttttcctaaataagtttaaatttgttctgctatctatattaaataataacagaggagatacgtttcaccagaatactaggggctgttggcaaagagatgggagaaactgtgcccctgctattaaaggactgaacaaactagtggtaaagaaataattataggctgggtacagtggctcacgcctgtaatctcagcactttgggaggccaaggtgggaggattacttgaggccaggtgtttgagaccagcctgggcaacatagcaacacctgtctctacaaaaaatttttaggaaaattagccaaggccaggtgcagtggctcatgcctgtaatcccagcactttgggaggccaaggcgggtgtatcacctgaggtcgggagtttgagaccagcctgaccaacatggagaaaccccatctctactaaaaatacaaaattagccgggcatggtggcacatgcctgtaatcccagctacttgggaggctgatgcaggcaaatcgcttgaacctgggaggcagaggttgcggtgagctgagatcttgccattgcactccaacctgggcaacaagagcgaaacttggtctcaaaaaaaaaaactaaaaacaacaacaacaacaaattagccaggcatggtggcacatgcctgtaatcccagctacctaggaggctgaggcaggagaatcgcttgaacctcggaggtggaggttgcagtgagccaagatcatgccgttgcactctagcctgggagacaagagcgaaactcagtctaaaaaaaaagaaaaagaaaaattagccaagtggaatggcacatgcttgtagtcccagccacttgggaggctgaagcaagagaatcccttgagctcaggagtttgaggctgcagtgagttatgattgtgccactgcactctggcctggccaacagagtgaaaccctgtctctaaaaaaaaagagaaaaaattacaatatatcagtaatgtgatacagtggtgatatttatatattgctatgacattatagaatacaagttggtaggagaaagcttcactggaaggtgacatttgagctaaatttgaaaggataagacttcgccaagaggagagtaagttgaataaggatattctaggcaaaataaacagctgtgctaattcatggagtaggtagtgttcagaaaatggtaagaaacttatgtgtatagagaatagggtttgggccaggcgtggtggctcatgcctgtaattctagcactttgggaggctggggtgggcggatcacttgaggctgaagttcaagatcagcctggccaacatggtgaaacctcatctctactaaaaatttaaaaattagcctggtttggtggcgcacacctatagttgcagctactcgggaggctgagacacaagaatcacttgaacccgggaggcagaggttgcagtgagccgatgcactccgggctgggtaatagagggagactcagtcacaaaagaaaaaaaaaaaagaagagagtttgtgagcagatggaaaatactaggaaatgagaataagataataaagcagatcgggatgaagttatgatgtactttatccatgtaggagagataatattttacaaatattaaattaatgcattgtaatgtctctgtaaaagcatgctcctttgtattcttctcatttcaaagtcaactcatgagatttatcgtaccaatgaagaggaaatactgtaaagtggcttttgatttgctttgagtctcaaagcagactttttttgaccttcacgagaggatagtaattgtgagagcaaggttttgtaaggttttgtaagagacagaaaaggatttactaaatttcttggtttctccccttaatatttcaaaagccagtctgtatagtttgtatgagggagatctgatccagacagaaaggctaagttgggagagctgcccctttgcatcttcgtggattacagcagaaagtaaagaaacaggcagagtgaggaaggcaggcatcggtaatgtctccctctccttccagttcatgctttcaggcagcagagggattggaggtaaagggtggggcataagagggaagagcacttagaaaaagtaaaacaaggctgggtgcagtagctcttgcctgtaatcccagcactttgccaaggcaggcagatcacctgaggtcaggagttcaagaacagcctggccaacatggcaaaaccccttctctactgaaaatacaaaaattagctcagcatggtggcccatgtctgtaatctcagctactctggaggttgaggcggggaatcgcttgagcccagaaggcagaggttgcagtgagccacgatggcgacactgcactccagcctgggtgacagagcaagactccgtctcacataaaaaaaaaagaggggactggagactgtgggtttgcgttgttgtcgtgggcaatggggtacagtgacctttaatgccatggaaggcttggtagaaaatgaatttgagacagagaggaatcaagagttttgccttgtctgtgttaagtttgagatgctaattaatccaggaggagatatcaagttaggagaaagatatacaagtctagagaagaagaatttagaattggagatgggagatcagtctacaggtcatctgcagcatataaatggcatttaaagccaagcattacctaggatgaggtcaattacacagggagtgaggaacttctttcctcactaccaaaggctgtgtgaagtgcacagccttctcctcccaccttagagactcttggagaggaacagtggagaaagaagaaatctgagagactaagcatgctaccttaagtgactatgcattaatccaaagggatatttaaaattgttttactagattatgtccacagatttagaataaaattttttacccaccacacagtaagtgaaggcttatgggaaatataggatcagccctagagaaaataaagaaattccattttctttgctcccctgaatataatgtgaataaatctaagatcttttatcacatataattttaaatgcaacaattcttactattaacaaatatctgctcctattactcccctgaaatgaaattcatggataataaaacgaacctatgcatagtttcaaaaacaatcaatataatatttaacatcatatctgtataagagaaaagagaggaaagtaatttgtaataaaatagtatttatttcagtatgtcaatgctcaggcacagctatactagaaaacatgaagcagtcagatgcttgcatctatttatagttacatatcataaatgtgacagccacaatgcaggtacatttttggcaactcaaatatcccaagcagcatctaccgccagtggtaagattctccaaaatggtgaacaaattttgtaaaactctgaacaaagaaaagtaaatgcttccctcaatttacacaatacttccatttctagaaaattcttgtttatatgctgaaacagattttcacctacattaattgctagggagacacttgaaagttgtgcaggatgtggacaatattttgttgagaaagactctttgttcacacactgcaggatctaactttcccagcccctgcccaataaaagccagtagtacttctaatctctgagacaaccaagaatgtccctacacattagcaaatatccctagggaacagtatcgttcccactgaggactactctttaagtgatgtaagactatgttttagttaatacagaatcaatgaaaatatgataagcagaaatgtgtccacacacaaatgttttggaagatattaccaatggcatcatatagattgaaatgcgtggaaattaatggccaacagttacattcagtggctgtttcagtgcttcagataatagatgataaaagctagattaagatcatggtattataaagggagagaagaatacaaatctagagacagtctaaagcaaaatgtaaaatatttaaaggtcaattagacatagattcaggaagacttcgaatgtagtatggctctgagctttctaacttagaagaccaaaaaattataatgctattaatagtgttaataaatacaggaaaaaaacagatttgaaggacatgggggtagaagacaagttaaattcaatttcatgcacgtatagcttgaaggaactgcagggtgattttgcttccacctaatttactatcattaattcattcaacaagtatgcattatcgactgtctgcctggtattgggtctgtggcagtaagacagtcatgttccctgtcctcaaggaacatagcatttaatgagaaagacttaccaataattatatatataattctctagttataattgttgttagtgaagttgtgataagtgcaatagtttgacatccagagaaaggctgatctatatttgggcagtaaagagatgatccttgagtggaaggcaccagcaaattttatgctccccagtttctcaatcatatttctttatgtccctctgcattggtaggatatgacactggttgaaaaaagtattgaaatgacctattgtccaatttcctcacccattgtcttgtgatctttgagcaaggcttgaaaactttatgatccatcatggctttcatgggagaacagagctgttacatcttccatagataaaaaatgcccacagctgaactcattgggaaaaaaataaaacaaatctttttccctgtttaaattcagactctttattaccaaacactcctaactcttagcagggccataagagtaactgttcttttaaaagtcttatgtactgccgggcttggtggttcatgcctataatgccaacactttgggaggccaaggcagagggatcacttgaggccagtagtttgagaccagcctaggcaacatagtaagaccctgtctctacaaaaaataggaaaaatttgctgggtgtggtggtgcacgcctgtggtcccagctactcgggaggctgagatggaaggatcacctgagcccagaaggtggaggctgcggtgtgctgtgattgcaccactgcactccagcctaggtgacagagcaagacctcacttcaaaaaaaaaaaaaaaacaaaaaacctctcatgttggttctttcaaaaattgtatgagaccaacaatctttctaaggctaggaaagcgaacacccaatctaacaaaattgcagatcagttccagcaaaattagcaggtcctcagcccaaatcctgagggtccacaccagtacacaggaagactgagattacccaatgctcctcataccccaatggagactgtatcccaagggaatctttccctcctcagtcgtacctcgtgaagaaaagctggtggagcaattttttgaataagataaagtcttaaaaaatatcagaacaaaagggagggcattactaaagtgaactttggtgagttataaaaatctatggataaattaagtttcttcttcctataacatggccaaatgatgttcacaacatgcatcttcaaatcactcaatattggccaggagtcatagcatcaactcaggacaaatgggaaatattttccatgttttgcaattttcactggaaaaccatatttcaaatatacttttaataaataaatcactactcttttctaactcacagtttgaaaaaccaaaatttgtgtgaacttctgcattttgcccctagacgcaaatcctagttaacacacacactcatacactctacttttatttaatagaaaaaatctaaaatattataatccggctgggcgtggtggctcacgcctgtaatcccagcagtttgggaggctgaggcgggtggatcacctgaggtcaggagttcgagaccagcctgaccaacatggtgaaaccctttctctactaaaaatacaaaaattagccgggtgtgatggtgtgcgcctgtaatcccagctactcaggaggttgtggcaggagaatcacttgaacctggaaggcggagttgcagtgagcgaagatctcaccagtgcacgccagcctgggtgacagagcaagacttcctctcaaaaaaaagaggccgggtgtggtggctcacacctgtaaccccagcactatgggaggctgaggcgggtggatcacctgaggtcaggagttcgagaccagcctggctaacatggtaaaaccccgtttctactaaaaatacaataataataataataataattagccgggcatggtggcatgtgcctgtaatcccagctactcgagaggctgaggcaggagaatcgcttgaacccaagaggcggaggttgcagtgagccgagatcacgcgactgcactccagcctgggcgacagaacaagactccgtctcaaaaaaaaaaaaaaaaattataatccaggctacagtggaaataaaaatttaacatctatcttcacttaaaaaatatctcaggaccaaaagaccacgaattcataaagctctcaatcatcctgcaaacacatggtagttctgttaagaaaacctaggtgattagacatttttggaaacttaattaaagaggggtgctcctaaagatgaagacagttttgcatctgtgacatgctgttttcctatcatccttgataatttgaaaactacagacatgtgcatctctttgtagcgtagacagggtctatggaacatctacagaagagtaattaatttgtgtgaatgtctaattcggaagttgtgggaaattatgtattaaaatattctgagtatttttaagaagttgtataatatatacatgattaaatagatagtttaagtcaccaattattctctttaaatgacagttctaatgcagatagaattggttgcatttctgatgataggtgtgtttttaaaaaattgtttatgttaactaaaaatgataattgtggaaaatattgagccaccttgataaatggggccagaaaagaaatgatgatgaatagattcaaatcctagggcataaattcaaatcaaatgtatttcgataatgaggtctcacttagctataatctatttgggagcctctattcaaattctcagatatgggaacttggaaaacacaagctgatgtaatattctgaaaaatcctccagggaaaagaacatctacataacaagtgtatcaaatgaattttgttcaagaatttaaacgaaaatgttaaagctaaaagagcaatactggattatgaaagtaaaattattttgcattatcattttaaatcattctctctgtttgggaactgtagtagttcctttcaagaatatattccttatctgaaatgaaacttttgtctgccttgggtaaaaacagtatcattttcatgacagcatttagcttaataagagtaataaaacaaaagactcccataaatgcatagtagtatataaatagctcctactttggccacacccacctaaaaataaggaaagattaatgtttataataaatcccactggatttgagaatatttttgaatttgaatatgaaagttcctatgagaaacatttgcattttgccactgcaataaaataaagcaaattgtaattaagatagaatttaattaaaacactttactaaattgtaattcttgaatgcctaccaaaccattgtgataatattctcaatgactagttaagatagaaaaaagctttttaattttaagtagttttctaaaagtataaggaatcctcacactaatcttagtttacagttcaaaatgttaatatatggtaattaggctaccttctaaattactattagaaagtaatcattgtgatattttttcttttcttttttttttttttttttttttttgagacagagtctcgctctgtcacccaggctggattgcaatggcgcgatctcagctcattgcaagctctgcctcccgggttcatgccactctcttgcctcagcctcccaagtagctgggactacaggcacccgccaccacaccaggctaatttttttttttgtatttttagtagagatgggatttcaccatgggctcgatctcctgaatccacctgccttggcctcctgaagtgctgggattacaggtgtgagccactgcgcccggcctttgtttctatattttaatgtattcaataaaaatttagttatatgaatttagcaagatgtaaatacttgtgattatttatggagtcaaaattgttatacgttattcagtaggtatatactatcttcttatgttggtacaaataggaatctcatagaatacttataaaatttagaatccttgatagaccaggaaggacaattataagttacctactctgaaatctacattaaaaatttgtttctgaattataaaatcaaacatgctcaaagcaaaagtttaaaaaagtgtatgtttgatattcatttatacttctgcaactgtcttcattcacttctattcttctactggtttcggtgcctttttactattgattttaagagctctttgtttattatggatactggtcctttgtttagcagatgtttggcaattttttttctagtttgtggtttactgattattgtttactatgtttgagattatttttcgtacaaatctttatgtagtaactttagaattattcatttagtagcttctaattttcatgatattcttttaaaagtctaccttattcagccacattttcttcttatacatttataattttgtttaataaaacttaagcttttgatccagctatttggattatgttgttaagaataaggtagatagccctaattttccaagtgtctagccacttatttcaatatcatttataatcacttttttcctctcacttggagtgataatatcttctgcagtagacagaagatatatatcacagatgcccacatcctaatctccaaaaacctgtaaatatgttaggtcacatcgcaaaggaaaattaaggttgctaatcagatgaacctgtgatgtggcacgtaccctggattatccaagtgggcccaatgtaatcacaagagtgcttgaaagtggaagagggaggcaaatgggtcagagccagagaaagagttgaagatgctatggtgctggttttgaatatgggggcaagggtcatgagagaagcaaagaaggcagtctctagaagctggaaaaggcaaggaaacagattctccccagagcctcctgaagtcatgcagtactgccaacaccttgatttcaacccaaagagacccactttggacttctaatttccagaactgtaagataataaatttgtattgttttaagccagtaagtctgtggcagtttgttacggcaatatatagcagatgcacctgtcaacaatagcttaacttaagcttaccctgagaatgaccttacaatctaagaagagggtgtgttccaagtttcaagctaaggaatccaggagtggccaacctgaaaatttattccttattctatgaagaacatctgaacccccagtccattccatggagcacaggccatactgaggatcaaggccctttgttttgggttaaaggaaggtttcctagtggaggttgctagggggagggtgctaagtgaaagtgcaatataaactgcatgctttttacaattggttgcaattctcccatccagcccaccaccactgcacttccctgtatgtaagtcctctcagtaagccctatgtctcatttgctggttccaggtctcctctttggcctctcgaacacgatgccatccatattgaagtcaataggcatctggcagaagaggcagcaatagaaaacaaagatggcttcttttacaaacaaggaaatagataaagtgacattaattttctaattgatagtaaacttggttaatatagagggctgcttacttttatgtatgtacttacagttaaagcacttacttttataattaataaaggaataaggagaaagctaaaacttttaaaaaaaggacaaatatttgaagtgaactacaaataaaactattaaaagatagaaggcaactaccatgccattcaacagtactatggaaagttatggcagataactctaaggactggacagtcatattgttttttaactttagagtataatttactttattttttgggacagggcctcactctgtcagccaggctggagtgcagtggtgcggtcatggcttattacagccttgacctccaggactcgagtaattctactacctcagcttcttaagtagctggaactacaggcacacatcaccacacccagctaactttttaatttttagtagagacaaggtcttgctgtgttgcccaggctgatgtcaaacttctgagctcaagcgatcctcccgccccggcctcccaaagtgctgggattataggtgtgagccactgcatccagacatagagtataatttgtatggatgtacttgacatttttagaatttccagagccacacaataatggccacaattaggatgccataaaatgaacttttgcttataagaaataatgaagctttctagattatggaaccttacatttctacccaatttatgatttcctttccacacaaaagttggacagaagaacttcttatacaagtgaaaagtgtagtttatgcagagaatctttctaagtgtgcttcctttctcatctcatccttctggtgcagagaaagcgtgaagttttaggctttaaaagagtgttgagagatttatagttaagatgacactaaatataggtgttcattgcaacatacggcaccaaaaatgtatatgtaatagataaaaacattaagaaagaaaaccaaaaagacctagtcagaccaaaacacaagataaatatccatggataagaaccagaagagaaatgccacaacctctgctagattctgaacccaagaataggcactggtggctggaatttggtttttgaaggctaacagggccagaaaatataccatgcaagatagaagaccgaaactacatccattgctgaaactacatccattgcccaaagctaaatcctgaggtggaactcacctcctaaaagggaataacaaagcattgttgtatctgctgctttgttcatacttcatttgaagctttcggctcaggcagggagaaaaataggcacagttccttgaatatgacgcaaagcaagacaccagctggcttgataaacaaatctgcaatattaccaagtcaatatttgtgtaccaaagactccaaactcatacgatatctgattttggcctgggagccaggggatctgagcagaggcgaccatacaaccaccagacaagcggatgtgaacacagaggttgagagagtaagagagaaacgtaaagtgaaacttcaaaatacatatttgtgtgtgtgtgtgtgtgtgtgtgtgtgtgtgtagccaacagcaacactcaataaaataaaaaatcagatgaactgatctcagatgaaattagagaacagtctaaaaaagatattaaaataaattcttagtaagttaattgatatgaaggtaaagtttcaaaaatgaaaaattttaaacaaaaggagaaaaaataaaggatacaaaaataaaagaagaaatagatatatgtgacaattatagaacttataaaaattaaaaatagaggccaggcacagtgactcacacctataatcccagcattttggtaggccagggcaggtggatcacttaaggctaggagttccagaacagcctggccaacattgcgaaaccctgtctctacaaaaaatacaaaaattaaccaggcatggtgatgcatgcctgtaataccagctacttgggaggctgaaacagaagaatcacttgagcctgggaagcagaggttgcagtgagccaagattgccccactgcactccagcctgggcgacagagtgagactctgcctcaaaaataaataaataaataaataaataaataaataaataaatacaataaaatacaactgcacactactagcatacctaactagaaccctcctacatcattgatagcaatgtaaaattggacaaccactttggaaaacatctttgcaatttcttatacagtaaaacaagcatttcttgtatgattcagcaatcacattccaaaatactggctccagagaaataaaaacatgtttacacaaactcctgtaggagaatgtttgtagtgagtctatttataatagcctccaaactggataaaactcaaatgtccatcaactagtgaataatgaatgggtaaacaaattgtggtacattcatacaatgaaatacaactcagcagtaggatggcacaaagtaccaatacatgtaagaatatggataaacctccaaagcatcatgctaagagacagaagtcaaacgctgagttctgtatgattccatttatataacattctgaaaaaggtaaatccacagagatggtaatcagatcattgtaacagatcggaggtagaagagggattaaataacagggagcataaaataatttttgggtcaatggaaatgttctatattatcacattatcaagctgtacacattaaacagtaaatttcattctatataaactatacctcagtaagcttaaattttaaaaacaagaataaagagaaaatattagaagctaccagagagaaaaagaacacattttgtcctcctgcgggcctctcctctgcgataataggtgccaaaaagcaatgaagtaatacctgtatagcaatgaggaaatataattatgaacctaaaatttaatatccagttaaactattatttgggttaaaatacattttcaaatatacaaagactgagatttttatccatggattctcactaaaagaactaacaaagaatgtccttcagcaacaaataaaaccagcagggatgcaagttatattttttaaatgatacgctcaaaaattaataaaaataaagttaattaatattagtattgactgtaaaaaaaaaaacactacttttgaaaacccatctctaccaaaaatacaaaaaattagccgggcatggtggtggacacctatgatcccagctactcgggagactgaggcagaagaatcacttgaacccggaggcagaggttgcaatgagccaagatcgcaccatggcactacagcctgggcaacaagaggaaaaatcactctcaaaataaaataaaataaaataaaataacaatcataacaggatgggagagtgtagtcagtaaataactcaagcatgctaagaatattttcatgtttggagaagcatagaaatggcaaataacttaaaacgtataaaaaattatagttaaatattatgtgaataaggattaccactaacatacatatgtgtatggtatgtaatacatatataaaattagtataatttgtatgtaatacatatatataaaatcactaatacatgactcagcagaggaaaagtatgaaaatggaaaacttttggtccaagagaagacagaaaaaaatttttaaagcaacaacaaagaagtagggagaaaacataaaataagatagtaaaaatcagtacaaatataccagaaataataataaataagattattagattggattaaacaacaaaaccttactctaggctgctaataatacactaaactaagaccgtacacacagttaacaagaaaagataaagataccctatgcaaatactaaccagaggaaggttattttagcaatataataaataaaaaataaataaagggctatacaaaatagaacattaatagaaaaaaatgatataacaaaatagtaacacaaaacagccacctggatgttaaaataatcacgttacaataacaaaacagccatgaaacatgtaaaatagaattgcaaaaattaacaaaatctatagtcattatggaagattgcaatgcctctttatcagaaactactacaacaaacagccaaaaaatttagaatatagaagatttgaacaataaagctaacaacatgatgtaaggtatagagtcctgctccctatgggtttacatattcttttcttgcatgcttagaacatttacaaaaattgagcatctattaggtgacaaaacaataacaatgtatattaaataataaatcaacaataatggcaaaaatagatatacatttgtaaactaaaggatgcactcctaagttcttcataagttaaatggaagtgaaaatgatgaaatatttataattaaatgaaaaaaatgtaatatactaaaaaaaaaccctgtgacatacaaccaaaacaataattgtagagtaattgtacagttttaaatgcatttatttaaaaataagtaaacctgattttaaatgccttaagttgactcaggaagctagggaaagaacagtgttgtaaactttttaaaaagcaaaactaggccgggcacggtggctcacacctgtaatcccagcactttggaaggccgaggcaggcagatcacctgaggtcgggagttcaagatcagcctgaccaacatggagaaaccccgtctctagtaaaaatacaaaattagccggtgtagtggcgtaatgtaattacatgcctgtaattccagctacttgggaggctgaggcaggagaatcacttgaaccctggaggcagaggttgcggtgagccaagattgcgccactgcactccagcctgggcaacaagagcgaaactcagtctcaaaaaaataaatgaaaaggaaaagtaataaaataatgacagcaggaattaataaaagaaaaaaattttaaagcaacatataaaaatcaatagcattccatatagctgtaaaaaatttgaaaatgtagtcacaaaagcctaaagacatatattgggcctaagaatacatattagcctaagaacatacaagaataaatttatcagtatatatagagaataatttttgaggaaattgtcaaagattattaaaaaactattaacgaatttcactatcttattgttcagggaacaacaacacaaaacaaccaagaaagaggacaaagaagacctgattcaatggagaaatatgccatgcacatattagagaaatttaatgttgttaagatgtcaaccttgcccaattaatctataaattcgatgtaattctaatgaaagtatccaaatggatttttcatggaccctgagagctgatctaaaatttcacacagagagcaaaggatcataattaagcaagataattttcaggaaggacaaattgggaaaacttacattcccagatagcataactttttttcttttttttgagacagagtcctgctctgtcgcccaggctggagtgcagcagcgcgatctcggttcactgcaagctccgcctcccgggttcacgccattctcctgcctcagcctcccgagtagctgggactacaggcgcccgccaccacgcccggctaactttttgtatttttagtagagacggggtttctctgtgttagccaggatggtctggatctcctgacctcgtgatccacccacctcgggcctcccaaagtgctgggattacaggcatgagccaccgcgcccagcataacttcttttaagaatatgaatgccaaatagcatgccatacacacggtgatagatcatgaaaagcataaagatcacagaagcagtttcatgcctaaatggaaacttaattatgacagaaatggcattgcaaactagtgagggagttatgggcccgtcagtgagtttgttggtacaattgctatccatatggaaagttaaaattatcacacaacatacagaaaaatctgttctaagttgaagaaggaatactatgaaaagcaaaacttagaataaaacagagagaggatagggaaagagattatcaaaagccaaattacagaccatgaaggaaatgtttgatacatagatgtaaaacatatatatgtatatgtaaatactcatatatgtcttaacaaacaacttagcagaaaaaagttgtgggtaattcaaatgaaaaaaatcttagaaggaataagacataagaattaaaacaacacaataagaataaaaccaataaaataagaaagctaaaaaccaataacagccagtatataagccaaggggaagaatatgagtgggtgagcacagtgtacaacactgtattctcccacagtttgtaagtgcagtggcatcagtgtaatttgcattcagctgctattacttgatgacacaaaacattaaaagattggagaaaatgtgactcgattttactgacatcatttctttatataccaatttataaatctaattcacatcacagaaacttgattggtagcagaacaggctaaatctaaagttgaagatgcataaacctatcaattacacttttatttatatcctctagagaaaatctcagatatgtgcacagggagacatgtacaaggatgtccgttgcagcattcttcataatagtaaaaaatgagacaggtacaaggatgtccattgtggcatttttcgtaatagtaaaaaatgtgaaaaaagtgtcaatataattcatcagaggaatgtaaaagtcaagcgtatattcaaataacagaataccacatcaattaaattgaataaactagaaccacataaactaacataggtaacttttaaaaatctaatgttgagtgaaaagaagttgcagaatgatactacagagaccatttatgtaaagttttaaaatatgcaaaatacttacataaaattgtttatggacgtatatatataataaaaacgcatataattatataactatggatatataaattttacataaactaagtttctttaattaaaccaaaggttatttgtcttttcagggcagacagaggcactttgctccatgaggttacccaaggacgttgactggcagggtggctctgccttcacatgtggcttccaaggctgtttgagttaccactttccagccggtgagaaaaaggaagcatctttaaagaggttatctaaagttgcatcatcacttccacttatgtgcaattgtccctaaatttagtcatgtcttgttgcaagggaggctgggaaatgcagtttattcatgtggccacatgcccaaggagtaaataatgtacagaaggagtaaataaggcactgagcccaccagatgtctcagccacaatagtaaaaatataaaagcagacacgggaatgagagttcttgtctctaggaaagaagagaagggaaagaaatgagggagcctacatagaaagttttaaatgtgatgtttaaaaaaataatgaatatcaagttcaacagagcttaaagggaaaaataaataagtttttaaaaaatgaatacaaatctgacaaaatgttagaatttcttaaatctgagtgatggagataaaggtattcattatcctatttttcacaggtttgaaatattttataaataaacaaatagcctttaagtacctttggtaagtgaataatgatatgcaaaagaacaaataagtagatagtagttgtagttgccatataatacaattttcatctacattaagtgtttaccgaatatattgtaataattaaatcaacaaaaccagcattacagtctttctaaataatcaactgtgcatactaaaaacattttacatattttcacttttttgagacaggatttcactctgtcacccaggctgtgagtgcagtggtgcaatcttggttcactgcagcctcaacctcctgggcttagttcacctcagcctcccaagtagcttggacaacaggcacacgccaccacactcggctaatttttggtatattttgtagagacaggtttggtttaaccatgttgcccaggctagtctgtaacctctgtgttcaagttatctgcctgcctctgaaatcccagagtgctgggattacaggcatgggccaccacactcagccccccattttaagtatttttaaaatgctgaagttcacctgaggtccttaaagcacaactacagcctagccttcttagtgaatctgagaaggccgaactgccctaagcacatccacccagtctgtttcttggcttcatctctttttggtgagcgacagctgttttaaggggctatatgcaaggagggttggaggtagacaactaagaggatctaagaaaagaaacgtatccagtccatatccatatcacttaattagaggggacaaatcaattactcaaatcaaacacatacatagttttctctaaagaggtctaattcataaattttaattaaaaagaaagatttgtatagtcctatcatcagaactgagttttttcataagaaatcaagaagctggcaaatacatatgtttaatttactatattgtaatcagtgaaaatgtatgcttttaaaccagctacaaattttaatcatgaaagtacttatttagatttggaaggattacaaaatgcaggggaggtaagactgtttaataaactaacagaaactgtgttaagccctattacacaaacaattgcctcatcttttgaattgtacatgataaagcatattaatttctgtgtaaacaaacacattacttgatatggtgtgattgtgtgtttttaaataaatgataaataagtagactatatatttatcactacatgcttccacagatcttatggattttacgtttcttcatattatatggggatatatatctccctctcaatgacaaattccacacaaataaatcattaagattctgagctaaatacttttttttaaggatagaagttcttaattcgcctataattcttactttttgtaccaaccaattaatgtgatggcttaaatgtaatgggtaagttaatgcatatattatattaaatactttattaactatgtagccctggattgcttagaacgatgctgctcacagtgagttttgtgtactggtgctaatctacaagctgttagtggttgcggtgtagtaagctcaaaaacccagaatatagttttggcaacttttatagcaatttaacaacaattttatgtctattaaatctaaaaacattatttcttatttaatttttcaagtaattcatttctaatatgttggtattggtccacaactaattggaaattcaaaaacttggttgtccccacagatagtttgagaaataccagccaaaaaaaaaaaaaaaaatctagtagctttgaactaagagccttaaagctcccagacagattgatttaataattacaatagtcattgtaaacaatattaataatactttatatttatttaacatttaatggttcaccaagcatctaagtctggtaggatagggctcattatctctacgttatagataaggaaacttaaactgaggtaagtgacctggccaaggtcacctagttactagatgagagagctgtaaatggaacatgaatcttacaacgctaagccaatattctttctggtacatcatgcacaagagtaaaataatgctggtttgatagaaaagttgaaaccatgattgtatcactcaactttgaaacgaagttattcatgtttttaaattcagttgttcttggggatacagagaaacaaaagaacctattcagatctgaacttggtcttttagactgcggcctttaatgtcaaggaatattacatttttacttccattgtgcacacaagctcaagggtaataaagtgttaatattttgttgatgtatcaagtttgaaatgtgaaggagtgaaatagaaggcatacatttaaaaaacttacttttttcattgctatgcagtagatgtacatatttccaataataaagttattagaggtacatgtgataattgaatacatttatataatttccaatgatcaaatcagtgtgattggaatatctatcaccttaaatattatgccagaaacattcaaattattctcttctagctatcctgccatatacaatagattattacaaatagattactgtatagtcaccctactgatctatcaaacacaaggtcttatttcttctatcaaaaccaactttagaaggcatgttctagtcagtgctgtctaatcatgctacatatggctatttaaatttaaattagttaaaattttaagttaaaaatttggttttttagttgcatgggccacaatccaactgcttaatacccacacatggttggtggttaccatattgaacatcatagctatggaacatttccatcactgtagaaaattctactggacagtgctgttacagttttttcagagagacacttatctttgatgaatttaaagtagaaagatacagaaattaaaatcaggagtcttctacaataagaaaaatctagttttatatatatacaacaattatttccaaagccaaactgtttcgtacactataggcagtcaattaagacagtgaggggaattttatcctaaatttattagatacagattaacataaaaaacataaaacttgcattgaaagaagtctaattttttgagatagaaatttatcatgaaagtaaatagtcagtatgcctcaccactataatttaaaaaaagaaaagaaaaatatgtaagacgcaattaaggggaaataaaagaaacattcgatgtctctcagaatttatagcaatgccagcatagcaaatcagaaaattacgctcaataacacaattaggacacattggaattatggtggagtaaccttattatttggtaatagaaattaaaaatgcagagtagaaaatctaaaacaataagacaaaatgaattttttatagcaagcaaatcaaccatgatttagagtccaggaaatggaatgtgtttttagatccatctctgaagacagacatatggccagcatcctgaaggccgcttcctagccagctgccatgctcaaatcctgaggtgcatttcaggcaaaggcactctttattgtgtatgatctcgtctctcactctgatggagtatgctggactcacgtgaaagcctcaaaaactccttttactgctttatcttaaggctcacatcaaaggtgggccaacactctgttccacattgcctttcaaagtcagggaggtctgaaaacgcatccagtctccattttattattccagtgacatgacaggaagaaagcaaagcacaaaggaagggccaagagggaagacaatgcagaagagagctgcaggaacatgtgtcacagtccaacggcatttagagtaacttggcacctggcaagttatgtccttgacccatatgtaagctcctcctcttttagggcagatggagagagaaggagaaaattatttttttaatgtctcgaaaaaacaaaatatatttacttccaaaatatctcctctgaaatcaactgagataaccatagtttacccatcttttttgaaggctctgtgaacaatgtgtctgattcttgctaatgggaaggaattggttggaaatctaaaagtagctgtcagtgctggaagaagtgatcacagtgctcacaaagtgatgacgagaagcaaagaggtgctgaaggagaacaggctccgaagacaggtggacctgtgttcagatttagcctggacctcttactggctccataggaggagttgataacattcgatcagctacattacctccaattatctagggataaaggtatctatcttgcagaaggaggtaaacaatgtggctaaataaaaataatttttagaaaatctaaagttgccacagttggaatctaaagttgccacagttggaatccaatggaaaggcaataaaaaaaaacaaagaaaataacatttttatatactcattagcaaattactccaagaatgagaaggataatttaaaaaatcaagttagctacagactaatatctaatggcaatcgaggctaactgccgcaatgtggaagtgagatctgatcactgtagattagcattagcaggggcctctatgcaaaggctttcaaagatcaaagtggaaaacataaatgcgtgaagcagcagagagtggtgcagcctgtagagaactgaagaggctacaccagtcaaaaggtattcagattttaaaatgttttaaaaccacatgtgctgcacaaaacaaatctgcaggcagaatttgacttgagggatgccagtttggaacctcatacacaaagcaaagacaaactcccacctatggataagttatatacaatataaaacaaaaaaaaatcctgtcaatccaatataattcactttgcaccataaggggatgaggatctgggaaaacaaatgctacctacctttctaaaaaattggtattcactgactattgtattgaatgaatattgtggtcactattcatcccacatcctatcctttcattaacctcagaaaagggtgaaggaagaaggcattaaaatcactcagtagaggaaggtatggagagaggagtatggcgtcatcataaaatatcccaaaccaggaacaacggtaaaggtgagcctgaggaataggaaaatatcctgaaaagctgggggagaacaccttgcctagaagagcaaagaacagatattttcctttcttctccctttatctctttgggtaaaaagactggattaaaacttttataggagcattaaaggaagctgagggagtcatggatttttggtctgttggcttttgtggctttaaatcttttagcctgtgagctttcaggattttgccttttggggctaagaaagtttgtgggtcttttggacctttggaattctggggctatgttttctctcttggactgaggaatgctattgttttacagatacagggatggaaaaagtacagaacgaattgtttgagattgactctcagcctcaggctgaagtaagagaagtgaaggatacctgtatatgtctttctgaattcttgtagcagacacttgtcatttcttttgactgcccagcattggagtccttctctggatttggggaattctctaccttataaatcttgatgggagacaaagactccctgccccacacagaagctagatactctctttcctactttcctttgcaggtagaataaaatgtacccaggctccactttgactcaggagttagtggcgcaaggaagcaggcactgtgcggaatccaatccagaagctgcagtggtagcagttctatagtagccatagttagtgtttcttatatgttggcagctatttgagatgcagcatctgggcagtggtgcctttatgggactagcttggcttcagacttcagagttggtttcctgtgtaacctccaagcttggtttgacttccattctagagattctggggggtagccaatatcctttacgaaatccttttctacttattcttagcagagcttgtttctgttgcttacaactaagaattcttattgatacagctctgagatccaatccaccaggaaagtaaagaaagagttcaacaaacaagctctattgaaaaacagactgctctcatgctgtgttgggaatctgagcatagtagtataggtgagggtatgaagaatttaagagttatgtccacttacactgatattctactaaaactctctctgaggtcacctatgactttctcattgctaaatctaatggcctctgttaacttcccatgtttaaattttctgccatatttgatgctgttgaacattccttcctcctggaatctttattatctattaacagggaacatcttgagggcacaaatttagcaggactgtctttgtactcccagcacattgcattttgcctgacacatcacactcaagatttcaatgaataaatgaatgaatacatattgtatttttaactatgatgaaaagagaaagactaattgaataaagcacacaggaaatattggcaaagggtgaaaaagtgacagtcacctattttgagcattttgagcccattttaatgcagtgatcagcaatagatattatataagcaatgtattgattaataatacaaacaaataagacaagtaattgtgacataactaatatttatcaatgggattggtctatttgttaacatacattgatttatcaattaaattgaagactaaaaagataatgaaggagtcacaaaaactgcatgtaattgtcaggatcccaagaaacatcaaagaccggtgaatagttagttaatcaaacaggtttttacctcaacaaagtcaaactgatcttgtccgtgtaacaagatcatcacactttctggatcttcagagatcaccagattgatgtttaccatactgagatcaaaatctgaagataaaagtgatttttagctgggcaaaactgaacctcctctgtagaagactgagagttaaataggaaaaatcaagatcaacatgtcccaacctaaccagatatcaatctgtctgctgttactgatcaagaaccgggatcaccaaactgtcatcagtgggacaaattcagcccatcatgtgttttggtaaacaaaagttgactagaacacagccatacccacttgtttatatattgtctaaggctgcgtttgctcttcaatgacacagttgagtagctgggggacagagtgtatcccaaaaagagcctgaaatatgcactacctgctccattatagaaaaagttcactgacccttaataaaaaagatatggagaaagaagagaagtctaatttagatttctggacccacacaaaagtgccctgaaaatgataattcttttgctccatccagctcactctcagagctgaaacttttcctctatcctccctcttcctcacttcactacaatcaaggcttacaactgtgaatagtttatttatttttttctatactttggaatatttacatcaaaagtaaacagtttatggtaattaaaatttgtgattaaaaatctaaccacttctaaattatcccagttcttttccttgagttctcacattgttctttcttttttcaaaagtaatagtttccttttcactgacaatccttctcctgatcactccttgtcaacctgtttctctgctcttattttcccacagatttcttttcttttcttttcttttttagacagagtctcctctgtcggccaggctggagtgcagtggcgcgatctcagctcactgcaacctcctccgcctcctgggttcaagcgattctcctgcctcagcctcccgagtagctgggactacaggcgcccgccatcatacccggctaattttttgtatttttagtagagacggggtttcaccttgttagccagactggtctcaaactcctgaccttgtgatccgcccgcctcggcctcccaaagtgctgggattgtgagccattgcgcccagcctttcccacagatttcttaaatgcaatacgtgttctaagcactattttcttccagctccatacctgctcatgcaacatttatctttttccacagctttcaccatcattctgtacagctaatttccgttcactttaacctttactttaaaccccatacccgcatttccaaatgctgtaaatcttcatgtgggtatgttgtgttcctactcacatttgtctggtttgacatctaaatcattatctctgcccacaaaaacaaatcataaaccatacacaaaaatagcacagctgccgggcgcggtggcacacgcctgtaatcccagcactttgagagtccaagttgggcaaatcacaaggtcaggagatcgagaccatcctggctaacacggtgaaaccccttctctactaaaaatacaaatttagccgggcgtggtggcacgcacctatagtcccagctacgcgggaggctgaggcaggagaatcgcttgaacctgggaggtggaggttgcagtgagctgagatcccgccactgcactccagcctgggcgacagagcgagactctgtctcaaaaaaaagcacagctgttcattgtctacgttctctaacttggttaattgcatcgctctcctaccagttgccaaaactagaaacaagagaacctctcaccatctacatgtaaccaaacataaaattctaaagattcttgagtttaaaatgtatctggaaattttctcctccatgtcgtttccaatactttattttatactgtcatcattgaataccttcaaaatagctgcaaccgtattcctgttttggttgggctatttctctaatttatctttcatattgttcccagaattatcttcctataacacaaatcagatcatgaaacatctctgttaaaaaatcttcaagattctccttgacctacaaagtcaaaatgcttggagtggcattcaagggtgatcatgctctaagctaccttttcaggtttattaccaactaatctccaacataaagtttgaactctgacagcactggattatttttcattttctgagcatatctgtaatatgttcatatatgtctattatattatgttctgaagagttgagtcatactccccacccgcacccctgtgctaaccatcctacaatgcacttgaggaaaaataggtggtcatagtttggctggcaattagattttgcttgctaagacatatatgcaagctggctagattttgagaagggggaaagggaaaggaggacctcagtaaggtggttagaaaggctgctgaggaggttctgagccagaaccaaaagaaataaggcagttatatgagaaaaacttcccagaaacagcagtttaatgctgtttgctatatcattccttcct

SEQ ID NO: 578 - DNA, 104326 bp, Homo sapiens
aaaaagtcatgttctttgattaatgggaaataagcacaaaataagatcagcccagggagagtaggtgagcatcgtcaacttgggaggtggcaagaactgtatggtctgtagggctggcagtgaaggggtggaatctgagtgaccatgtgcagagacaggtggcactgagatatttctctatgcgctttttctcattatcagtgagttgagcagaagttgagacatccacagatcatcccctcttataaaagttagcatggcattttattttgtttgagaaatgtttgtttagttttgtatttagctcacttcatattcaagctaagactattctgtaatgccaaggttaattattttttcatctcttcattaaggaattgtaaaatttcttttaacttttaaaaggcgaactttcttgatcaataattgttttgatctctttcaaatgtcttatagttttcagactgctaatgcactagtttgcacttacagagggcaaagattattatgctttcatggaaaatataatggtttattcccaaggaattaaacttatttacatattttatggctagctttatttctttcatcaattaccttgtgatttgtcttaagtggggaggggatataatataagtcctactggtccataattccctgtataaccacaaacatccttttaaaagttcaggacaaacacaacatccagtgttctagaaaatgattatatttcctattaattattttgagaggtttgtactttagaaccttcagaattctcagatgaatgctactctttttccagaggtttaaaattttgttctcaactagccatttaaacatttctgtttttgataacttatgtaggtcttatttctcttatctataaaaaacaaacaaacatatgaatatttttcactactgtgagcaaaatattgaacttttttgtgagttttacatacattaaaaagtgcacaatatgtgatgattctgttatttccttaaactgtgtaagcctaatagtaatgtcttatattagaatgaatgtgtgaatagaatgcactgtagcacagtatcatctgtttcaacaaatgtgacaagttcatctactggtttaaaatatacaaacacatagttaattgctctcctttcagaaaacatattggttgttttcaggtgttgctaagaaaaatcaggctaagattaacattactataatttctccttatatgtatatgtacaacagttgcttaaggatttattccaggagttgaattatggtgtcataagatatacgtatcttttacttctaccagataatgtcaaatcattttccaaaggtatcatatcagattacattataccagcaattgttctacattctcacacttagtattgttagactttttaaaattttctctctggtgggtgtaaaattgtattatattgtgattgtgaaaaagtattttatggctgggtgtggtggctcacacctgtaatcccagcacttcgggaggccaaggtgggcggatcacctgaggtcgggagtcgcgaccagcttgaccaacatggagaaaccacatctctactaaaaatacaacattagccgggcatggtggctcatgcctgtaatctcagctactcgagaggctgagacaggagaatcgcttgaccctgtgaagttgcagtgagccgatatcgcgctattgcactcagcctgggcaacaagagcaaaactccgtctcaaaaaaaaaaaaaaagtattttacaatgactagttaggctgattgttttttcatgtttttattggacaggaattttttcttctgtgaaatatgtattttttttttcattttctattggagtaattatttgcctttaatatggtaaaaaaaattttgtagtctctaggtagaagtatttgtcagctaatattgctgaaaaattttttcaatttgtatattgtctttatggtgacttttgattaacaggtgtcataattccttacttttaaaaagtaaaagttctaaattttgcttttactacttacatattaagtattcctggaaatgatttgtataagatgtgaaatagaaatctcacttaatttttaaaaataagatcaaataattttgttagtacaattttttttaacaatccatacttttcctattgattggcaatgatagttttatcatttgggatataatgtgtaagcctgggtactatagtctctgtaatttatctattcattactcagtcttaattactatatgtatatatattgtctcattgcttatgctttacatatggtagagcaatttcaactcattcaggtatatattggagctagatattttatatacattttggtgttaaaaaaacaaaaacagaaacaacaaaacagatgatatagtgatgatgattggaggtactctgattttatatatcaatccggggagatttgatattggaaatattgagtcttcttagtctggttatgatttgcaactcatattctgtaatgtctttttttttttagtccccctgggctaaggtgatcctctcacctcgacctcctgagtagctgggactataggtgcatgccaccatgcccggctaatttttgcattttttatagagacagggtttcaccatgttgctcaggcttgtctcgaactcctgggctcaagtgatctgttcctcttggcctcccaaagcactgggattacaggcatgagccaccgcacccagcctctttaatgtcttataataaagttctgtaattttagttttagtcatagatattttagttgttttagaataattcatagtaatttattactattgtttgagatgggggtctcactttgttgctcacactggagtgcactgacaccatcgtggctcactgcagcctcaatctcctaggctcaagtgatcctcaaacctcagtctcccaagtagctaggaccacaggtgcatgccaccatgcctggctaatatttttaagtttttttttttttttagagacagggtcttgctatgttgcccagaactggtctcaaactcctgggctcaagccgtcctcctgcctcagcctcccaaagtgctaggattacaagtgtgagccaccaagcctggcctattttaatttctgattgataacttatatgaaaatttaatttatttttgtataatgattttatatctagcttttgcatttagaaattttgcccatttcttgtattaatttcacctgatattttctgttggttctgaggcccacactcaccttcaattctatccttctactgctgaagctagatacttaaaactgagaatttctagaattccttgagaacgaggttgggattattcctgccaaaggtcaacactctcaggagattagagaggaggagagaagaggaagatggaagccattggcctgtggcttccacaggcaactgttggctttcacagtatcagcagccatagcagaggtggttttaggcaactggttatagcaattgattatggcaatcatggtgtttgtgctggtaaccggcaacgaatggtgccttctgtggtgactaggtcatacttggggacagaaggaagtaagttcagaagagcacaggttttggaggctggtaaccagcaaagggctgaagttttctgcagtagtgcctgccccggcatagaccaccagatctccctatagtacctgatttcttcccccatttttcctaatctcgttattattttcactttgttttgtttctctaatccacgtagaaattttgtaacccaattactggcattaaattcttgtctcttatttccctttaactgactgtaccttgaattatatattaattatatatctacagatttggggggttttctatttagagtatcttataatatgcttattatgaaacacttgtttcttccttttaaatcttgcatcttatttctttatcctctctgattacactgactttagcatcttgtaaaagatggaataaaattgctcacagtaggcatagtctcgatgtataatataatttctattttaaaaggaatacatgattttaatatatttcactatgagttttgggtaaatattctttatcatatttggaaagttttcttttcttccttgtgttgaaggatgtaacatgaaagattatagactttttatttatatttttctccctgtgtttatcaaaatgatcatttagatattcacctttactctcctaaggtggcaaattacattaatagtctttgacatcaaactaactgaaatcctgggttaatctcaaattcttcagtaagttatatattgtttctgagttttcttctgtgtttttgtatctatattaaatagtaaaatggatataaaaaattctttcataatgtccttatctgtttttgtatcaatgttatataatctcataaatgagttgtaggatggttcctcttttctatttgtaaaaaatttcatcatctattatgtaatatttattacttactaataaaaccatctaggcatggtgtatttttgtgggaaaatttaaacttgccgaattaagttctttagtagttacggactattcagattatttatttctttttgaggcagttttgttagttggaatctctgtaggaaattgtaaatttcatctaagttttaaaatgttttggcataaagttttacagctttcttatatcatttgctatgattctttctcactggaagctgttgataggtgctaacttccactattttgtctaacgtctgctttgacaacattgccatcctggccaagaatgttgtctactattgcttgcaaaatttaagatcttaagatattaaaacaatgcacaaacactaagagttctcaatctgctaagaacatgacatatgtatatgtatatgtatatatgtgtgtgtgtttttgcataaacatgaacaactctactctctcactcttcctcacacatttttcccatgtcatgaagcattaatcctgtgcttgtatttcagagtcccttgaagactaagctcagattcagctttcagggtctctctccttgatatttcagcatgaatgatgcctggcgagggggctactctccacaatacaccatttttcagtctctatgtttcctgtccaggctgggatgttccaaatactccttcagctagtgaatttgcaaatcaactcctagagactgcagccatcactttatgagatgagatgtgccaaacatgttgatcaacaatgattattcattttgtcacagaataaatttttttacttcaattatgaaccctatttagtgatgctgttagtattttaaattcttgtcaagttaaattttatagtattcaatataaaattttctatgttaattattatagtttcctgataatggttttgatgttgtttagaagaatatttaagtttttataataaaattatgttactgatttttacatgtaatttcatttgattacagtattagacaaatctacatctttctaataattaattaatgtcttctgatgttttaactgtattgatcactgcaacgtagcccaatgacgtgtgttttaaaggctatctgtactgctgtgtttgtttatgtatataaaacaataatttcaatactaataatactttcattttatgttggaagctgttatttggtacctaatgttctgttaatgttattatacatcaattaaattatcctgtttgccttttacaatgcttgtgcctgaactttactttggatagagacaggaatatgatcaggaatataatcattatttgaaattatcatattccaaataatgatatggaattcaaaggcgtggcatagatcagagattagaagttaatattaaatacataaagatggtggatgaagtcttataagggaatgttaatattcatggctagacaacaaagaaatgaaggaaccagagaacataattttggaaacactaatatttaaagtattgaaataagagctagcaaaggagactaacattaagttggtagaaaagtagtttggcaaagaagtggaactaaaatagaatataccaagaaggtggagttgtcaacagcatcaaaatatttactgtgcacaaagaagttgacatccactttcagcccatctattcaaatatatagactacagtgtaagatggaagacattttaaaatgttttcttcactggggtatctccagattctaaaacattgtctggcacttagtagaaaggaataatatttgtttaatgaattaaatagataaatttatgaaatcaattatcacaagcatataacatttttagaaaagtgtactctgatactgaaatattttttctatgtccactatactacattgttacttatagagttaaaaagaccacaaagtagaacaatttgaagcactttggttataaaatagtttacttgaaactattgcatataaatatcatatattcatgtcataacattttttcctttagccaccctagtttcatgaagatatacacatctattaataaaactcaatttatctgacctaatattgatagtccatcataataaaatggaatttagaatgaaaccccagatgaataattaatatgctgacatttttatctataggtaaaagataaattgttaaaagcttactttaagaagtttattaacatacttaattccacctaaaaatttaaataataaaaaagcagttatcaaagccccataatttttaaatgacatagattcttctcaaattttatagccatataagagcaagtaaattattgactcaatctaaattaattaataaaagaaaaatagtagaaataattaagtcagtcttagaaattctattgtgtttatgttttttgtttgtttgtttgttttatttatttattttgagatggagtcttgctctgtcgcccaggctggagtgcagtggcatggtcttggctcactgcaacctccgcctcccaggttcaagcaattctcctgcctcagcctcctgagtaggtgggattacaggcgtgcaccaccacacccagctaatttttgtgtttttagtagagatggggtttcaccatgttggccaggctggtcttgaactcttgacctcaagtgatctgcaggcctcagcctcccaaagtgctgggattacaggtgtgagccaccacacctggccattgtgtttgctttttaaaaattgtaaagtaactggtagacttttgtaaaataatgccaataattaaaaaaaacttttcagaaacttgtataattaaaaggtaactgttgtcaaatattagttacttctgaaactattcacttcttcaaaatatgcttcttctgctcttaaagctcatttggaaaaagaaaacaataatgaattaaatacatatatttaccatttaaatgttttaattaaaattatattagggttgggctcagtggctcacacctgtaatcccagcaacttgggagaccaaggcaggcagatcacttgaggtcagaagttcgagaccagcctgaccaatatgatgaaaccccatctctactaaaaatacccaagttagccaggtgtggtggcacatgcctgtgatcccagttacttgggaggctgaggcaagaggatcgcttgaactcaggaggcagagggtgcagtgagccgagattgcaccactgcactccatcctgggtgacagagagattctgcctcaaaaaaaagaaaaaattctattcagaatctctgacatattcttgttaaatatagatttgaaaattataaaagtttctcattctgaatttttaaaataatatagaatttctatatactaagtttgattgatattttgatctagtgaaatgaattatgcataaagagaatctaaatcaacccattgacttcttatgattttaaagcataaaactttttggatatcagacatctttaatttttctccttggctttttgacatacatttttgcatatgcccagacacctatgtctttgccctgacaactattttctgtagaaatgctttgctttacttctctcagaataaagaatgaatgtttattgctcaaaatgtggagcactgtgttctgtaaaaatattctacatgttcatggtgtttgagaactagtcgtatagatctaaattcagatttctttgttctcatagcttattttcttacttaagaattcagatctgaaatttctgatattttcatcagtactagagttaacttgatcattgttttgtacatcataatgaccatcttttctataatttttaatccttttgtgctgataaaaacttttattattgaattatctttagccatgtttttaacaagtcagttgtctcacttgaagttcttattacagttgaacaaactgcaatattattccttcatatgaaaaacagcatacctttctcatcaaagctattaatataagaataagttgttaaacttaaaatttggtgttgtaatgcaaagtatatgtttgtaccatcgtccagtagtatctcctcaaatactacatattctaaaagttcctcatatttactttttattattgtaataaatgtgttgactgtgtgctagtcttagatatgaagctttaacaagtagcttttacttgggctaaacacaaccagtttaatatacgattttttaaattaacttgtgaatatgtcctcctatattacctttgacaaagaagtagtgactgaatgctcatggtatttttggattgactagaattactgcgtttgaagacacttaaagaatcatttgttgccagtctggagagaggttttcactatgatgtttgtatttacatctatcttgttcaatacttcaaatcaacaatttagatgaatgatttgtcatacctattagatttcagatttaacaagagaacatcaagtgggctaggttcaaaattaaaaaaaaaaacctgtctatatggaatgagacagtttgattttagcagcagagtgtataaaaagccttagaacttttatttggctgaaatctaaatgttagtcattagtgggatatgattgcttgaaaatacagatttaggttatattctgagaataagggaggtcacagtcttataatactttcccctagtcagaataacccttggtgtttgggtaacatcataaagataaataaaataaaataaaataaaataagctaagagtgtcaatggatttggaggcatttgaaaatatatataaactgtgttccttcagattgggaaattttacctttgaaaaataaagagtggtaaaactaacttttgtttccaaatgtttaagaatgcctgttggtgacttgttctgtttggccacaaattgttgcaacagtctcatggagaggaagtgccagagaggcagttttattttctattataagaaagagctttctaataatggtagatattcgataagggaagagctatcttaaaagtaatgatgtttatgcagctataaaaatgtattaataattcatgattttcaggctcagaggatgttctggctaaggaggtaaattggtaggacaagagacctctacctcaacttaagaaaaacaactccacatttttgtattttacatatccagattttataagatgaaaagataatgaagctatgttttaaaattttacaatcacagaattgcattggcaataatgctgtaaaaaacatttaagcatttgaaagaatatttgaattggacagcttttaaagtcttatcaaacatcattttaataataactataatgaaattataacattgtctacaaataaagtgctggagagcttgacacactctccttaatcctcaccatggccctgaaaacattattatactcattttaaatatgagaggaatgaggatcagaaaggttcagcattttggatgagggcctatggcatgtagaaggagctgggcttataaccttagttacactggacttgtaccattacacagtattataaaattgtagagttgggagtactcttagggatcatattctaaactattttggttctgttattttacggcatataagacatcaccatctagtgataggctaatttgttttttaatatcttcaaactcactcctctgttcttgggttatttaattacttttggagtagttcaaggttaaattaggaaggatcttcctatgtgaactgaaatctgctttttcatgcaacccaattaaaaatatagtgctttttaatgttctgttgctctggtctcttctttgaaggtatttatatttaaattgcagaaatacaatatgaagacaaagcatacaaatatattaagaacttccccagtaggattatacccttaaaaaatttttgtccaaaataaattataatttaaatcaaaagagttaacataatcacccattgtcattaggtctgttctggcaaacatatttgtaagataagagacgatcataacaagcatagtagtagctcaacaaacaaactacaaacatccattctaaaggatggttcaatctgcaactgaataaaagagaatcgtaagatctaagtggaatctcagctgctaggttggtcaaatcaatcaggaggcaacaaggatgtccttgacatgggtggagaaaagcatttctgttgtcagggcctgacaacagaaagacatgtgttaaaccaagagagattttaataaatctctccattcataaatatagggctccaagtcagtatttaattcccaggacaaagcagtatctacttcttagcataccggtcaaaaacagatatgggcaaatggtaagtctgatcactggattgcaattcaattcatctcaatatgtggatcaataacttaaacccaggtagacagttaattctagagtgaccaagttgaaaaactgattagaaacacacacacacacgtacgtacatatcatatatgtaagtacgaaatcacacttattcatcttaataaggaactttttcaattttttcccattactttatgttagaacattattatcactcaggagacaaattttacttttaaagatagaaatatatatctggtctaaaatgataactaagctaactatatatcaaaatgttggtaacattgataagttatattatcttctgtacaaaaaggtatacttgccatctgaaatacaatcactgagctggacctcatgtccaaatatgcccattattttctgtgttcccatttggacattgatgaccccaaaaaaaatctttccaaaatttggctttagaatatcactgaagacaataagagttgaataaaagtaacataacattttgggcaaaattaatgtatttacttactctagagaatccagtgaattttagcaaatgcaaccatgtttgctaaagctgagatagagcacacacataggatttcaggagatcaaaataagagccactatttcatcactgttattatgtgacggtgctatgggcaatacatggaagctaaatgtaattccgttcatttctttcttattttttctagtctctaattttatgagctcctagtaagctataaagtcttctgggaaaatgctagttcattttaatggaaatatgcaaataaaaagaaagcactgttagaaactatatatatatatatgtacagttattattatatatacaattatatattatatatgtgctatatatatatatatctgtataatacacacacacacactgagaagtatcacataatttggcattatccagcaatcaatttttgactgctgcttttgtcctgtgtaggatttcaggcttgaatcctaaaaggaaatatttctcaatattatctatattattttatttaaaataattataaccttatctttgtacttttacatctttaaaaaaataaagaatcgtatacagtcaaaccattttcattataaagaaatatcctgaataacaataaatggaaaaaactgggagtgttagagagctcatataaagtttataatgggagttacaaaaaggattggaaagctgtcatcatttgctaacacattctgcaatgactgcttaaaatcaagttaggttttttttttttttttgaaatcacatttctgtgtcactcctgatatatcattttagctaccctctttggttctgcttattttattatgatgcaatcatatttgctttcattttacagaagtatgacagccctgggaaaaatactgagaattctaacaaagtaccgataatgcaataggaaaaagaaggaaattagtatttcaactcccttttgttctgactctcatgtttttgacatagttttctgcaaattggtatcaatgatgctgcagggcagaatcaactcactttctactgcatatttagttattagtcttccctcttagtttacagggataaggcataatgttgacattggcttttttgttttgaacttaaatcttccagggaagaaaaaaaacataatctcttttccctccttctgtgattaatttctgcaatgttatatgtgagggaagctgagtgatgctgtgcccaccaagctgtggtggacatttgcttcaaagaagttagtgactttgcaaccagctctctgtgggtgtcacttgtgtgcagtggtgcagagggaaaatatggagaggatgaaaagaaaaccattaatgcagtttgtgtttcagattccatgccaatttaatattgtgtattaatgatgcattttggcaataaaaccatttaataatcattaaacagaaattgccattccccattaagtgcagactgtgttataacacatttgctaatttctcattaaattcaccataaattaaataacagattttgtgtgtataactaaggagaaaaacccctttaatttattttccaaagaaaataaacatcttttgggaaaattgtccaaaccttcgggttataattagagaacaaaacagaaagcttctttttttttatgtttaaaattaacatccaaagaaaatgaagattgttcaaatgtggtgtcttttgaaagaatggttgttaaatgcaagattcaaatttgcaacctacaaatttatttaactctcagtcattgaaaacacttcaagagaattaaaggtggagattctcagtagtgaagggaaaaggagagaaggggataatggttctagttcctccttacccccatttcccaggcatagttttgagatgctatctgaataggtggaattcgtttggaggttcacctcttatttatctatacggatctgggacagtcaaaagacttctaaactgggaatgttacactcattttcaccccagtagacgttaaaacattttaagtgatatttgatatttgttgttgtaacatgtgcttgattacaggaaaacttaacagaggcccctaagaaggaaaaaaagtacaaaggaagacatctgcatttttatctatagaagtgtggttctagacagagttcatgtgtacagaaaaactgttaaaaatctttgcttctgtcttgtgagattttgagtggttttaacactatttcttatatttctagctggcccttgaacaataattggtttgaactatgcggacgcagttacataagacttttttcaataagagtcacacccagtgtgcctgcttacttgcctccctctcttccacctcggaaacaacaagagcaacccttcttcctcctccatctcagtctactctaggtgaagatgatgaggatgaagacctttaccataatccacctacacttaatgaatagtaattatattttctgttctgtatggttttcttaatgacattttattttctcttgcttactttttttgtaagaatacagaatcacatcaatataccatacaaaatatgtgttaattggccttatgttattcataaggcttccagtcaatggtaggctcttagtagttaagtttggggagagtaaaaagttatacatagactttcaactgcattgggatgtcagagcccttaactcccgtgttgttcaagagccacatgtacatatttaacattcttctttatatttgtcattattgttgatttttctatgtgagtgtttttcaattggaaatatatgttcaaaaattattatagttgaaatgattatatgaaatacagagataaagacaaatgaaaaacaatgattacatttaatagtatgaatcatactgaatatttgttaaataaaaaatttagttagaattgtgactgggcgcggtggctcatgcctgtaatctgagcactttgggaggccgaggtgggctgatcatttgggatcaggatttcgagaccagcctgaccaacatggtgaaaccccgtctatactaaaatacaaaacttatccagctgtggtggcaggcacctgtaattccagctactcgggaggctgaggcaggagaattgcttgaacccaggaggcagaggttgcagtgagccaagatcgctccagtgcactctggcctatgtgacagagtgagactccatctcaattaaaaaaaaaaaaaagtatctgaaacagctctcactcagtttagaagtttattttgccaaggttaagggcatgcccggaagaaataaacctgaaatcacagaaacagtctgtggtctgtgcctttctccatagatgaccttgagtgcttcaagatgtaaaagggaaaaatgggctgaaggagaaataaggtgggtctggtaattcacatgttgtcagggaaaaggagcaggtagggaaatattccattatatattcatcttgtgctcagtaaattggcactttacataagataaggtgagcatagagtagctacctatggagacatttaaccttttatctgtagctatctgcttaggaacaaaaggaaaggcagtttcttttatgactcagttttcagctttatttattgatttattggcgtagtgaattggaatcctgagtttttgtttttctttcacagaatggatcgataatattatagagccttctttacatttagtgggaaatgatcgtagcagctatctaataattaagcagatgaagagtttttttgatgaattgatcaactgaaagtttgcttaaataaaaaatagtgttttatttctaaagcatgtctgtgcgaagttgaaacataatatcaggtagaaaatgtaactcgctaataaatgccatatacataattttaaatattcgttgctcaaaataatcttgtgatgccaaccttgaagtaaggaaatgttacaatactttgtaactcattcgtggcgttgaacatacctgcagttttatgaacagcatagtttggcaccagaccatgaagaacttctgagaaccacttaatccaaaccttcacctttactaagaaaggacaataccagaagtcttatgaaatcctatcaactttttcaaaatactacaatgtgctttcaaattttcttcgaaaatccatttcttcaagtcctacggtatttgcctgcctctgctttccccagagatttctcactgcttacttcaacataggtttttctaaattcctattcaattattaaaattaatgcctgccaaggcattaatagtgacaatactattagcctttcttctcctgtcctccttgcaaacttattaaggtacattgttaagtgagatttcctggtctctagtggttcaattcccacctactagagcttcttctttgtccttgacttttcttccctggcaatcaggctctgaagctgcttctcactaccagtcctttcacatacctcagcactaccctccaaaatgtttgttggcttctaggaatttttctgtccttctcctttatatcagtacttgtattgttcctaatactaggctttgctttgaaacatatgcaaaagctctgactaatgtcataatataaatatctcaaaacctatccaaaaagtaatcagtaaactaaactctctcttcctatatttgattggctaccttcatggaagcaaactgtggctccagacaaacttagatactcttgcctttcattccatgaaccagatgagtaaccagtcaaatcctgacttccaagaattaaaccttagaatgaaccctttctggatctttctctttacacactgctgagaaaatcctgaaacctggataggctagaaagaggagataacagtactaataagctacttcataccaaactttagatgcttcacctcctgaccagacacagtggccatgctgcacagactaaggtctgaaaccttttaattctgaaatgtaatgcttatgttgtgctcacatgtaaaacactttgttcacattaaattgattggatattaaccaaactaaactatagccaggctgttcagagaaagagagagagagagggagagagagaagatacaaactaacagcagaaggaattaaagaagtgacatcactatgaattctacagatattaaggaaatattaaaaccaatgttataataatatataaataaattcaacaatgtcaataacaaaggcacattatttaacaacctcaaactactaaaggtcatggaacaagaatagataaccaaaatagccttatatcgactaaagaaattgaatttgcagtttaaatcttcccataaagaaaattctgaccctatattcctgcactagtgaattctattaaacattaaggaataaataatactaattctacacaaactgtttcatataattgaagagaaagaaatagttctcaacttgttctataggtcagctttctcctaataccaaagggacaaagacattacaagaaacataaactcacacaaaaacacagacctatattctcataaacttatatccattataaacataggtacaaaaattttaatcagcaagtcagatgaaatgatatttttaaaagtataatatgttatgagcaagtgaatttatgcagacttgcatggttcttttttttttttttttttttgagacagagtctcactctgtcacccaggctggagtgcagtggtgcgatctggactcactgcaacctctgcctcccaggttcaagcaattctcctgcctcagcctcctgagtagctgggactacaggtgcatgacactacacttggctaattttttgtattttttagtagagatggggtttcaccatgttagccaggatggtcttgatctcctgacatcgtgacccacctgccttggcctcccaaagtgctggtattacaggcgtgacccaccatccccaacctggttcttttaaacatttgaaaatcagctattgaaacctatcataattgcaaactgaaaaagaaaaattgtatgattatctcaatggatatagaaaaagcatttggcaaaaatctaatatttgttcctgataaaactatcagaaaaatagaaactgaaaaagacttcctcaaaatttataaatggcatctatgaaaaaattacaactaatgttttatttcattgtaaaatactgactgatttttccggtacaatcaggaaacagacaagaatgactaccctcaccacttttccttaatattgtactggaggttctagccagtgtaatatgacaagaaaataaaatcaaaggcatacaaatgggaaaataagttaaactgtgtttattagcaaataacctagtcatccatatgaacaatctgatgaaatctaaaacaaatctactaaaactaataatggagtttagaaagtcttcagtgtgaaatattgatttgaaacatatcaattatattactatctgctggcaataaaaatagaaaaataaaaattaaaaaatgtaatttacaatggcatcacaaactattaaatacttaaataaatctgacctaaaatatgcaatgcttgaacactgaataaaaacacaacattgctgagagaaattaaagaaaacataagtaaatggtgggacatattttgctcataggtaaaaatatttagtattgttaggataacacctatcccaaaatagatctgtagattccacataattccaataaaaattctatcagttttatttttgtagaagttagcaagcttattgtaaaaatgcatatggaaatgcaaaaaaaacaagaatggtcaaaataactttgaagggaaacaaagtaggaatactaacattacttgatttcaaaatataaagctgaagtatttaataggattcagtatgatacttgcataaagattgacaaacagtttaatgggtcagaacatgagttcagaaatggacaacaaatttttttaaaactcaatatcatccctatttccttataaaatgaactcatgtctacacgaatacaaaaattttaacacaaattggatcttataattaagtgtaaaatatagaactataagatatctaaaaaaggccagatctgtggctcatgcctgtaataccagcactttgggcagccaaggctggggaaacacctgagatcaagttcaagaccagcctggccaacatggtgaaaccctgtctctactaaaactacaaaaattagctggacgtggtggcaggcacctgcagtctaagctactcaagaggctgaggcaggagaatcacttgaacatgattcaagtggaatcatgttccacttgggaggtggaagttgcagtgagctgagattgtgtcactgcactccagcctgggcaacagagcaagactccatctcaaaaaaataatagtaataaataaaataataaaataaaataactaaaagaaaacaaaaaaatctttgtgactgtgttagttcattctcacactgctataaggaactacttgagacttggtaatttatgaagaaaagaggcttaattaactcacagttctgcaggcttaataggaagcatgtctgggaggccacaggaatcttacaaccatggcggaaggtgaggaggaagcaagcaccttcttcacatggcagcaggagagagagggcgagagaacgggggaagtgctacacactttcaactgatgagatcttgtggaaattctatcagaagaacagcaagggggaagtccacccccatgattcaatcacctcccaacagctccctctgtcaacactgggaattaaaattagacgtgaaatttgggtggggaaacagagccaaatcatatcagtgacttcgggccttatatgttgcaaaaataatgaaataaaaaattgataaacttgaatttatcaacattaaaatatttagtgcttcaaaggacactgttaggacaataaaaagaaaaactgcaatgccgagaccagctgggttgggacaccctaacccagcggcgctagaggaattaaagacacacacacagaaatatagaagtgtgaagtgggaaatcaggggtctcacatgagagccccgaacagagatttatccacgtatttattaacagcaagccagtcattagcattgtttctatagatattagattaactaaaagtatcccttatgggaaatgaagggatgggccaaagtaaagggatgggttgggctagttatctgcaggaggatcatgtccttaaggcacagatcgttcatgctattgtttgtggtttaagaatgcctttaagcggttttccaccctgggtgggccaggtgttccttgccctcattcaggtaaacacacaaccttccagcgtgggcgttatggccatcacgaacatgtcacagtgctgcagagattttgtttatggccagttttggggccagtttatggccagattttggggggcctgttcccaatactacaaacttgtaggaaaaaaaattgtaaatgacttattagaagatacagagaaaatataaataatccctaaactcaataagaaaacaaccaaaaaaaaattaaaaagaatttgaacagatactttactaaagaagatatatgaataaaatataagcatgcaaaaataatcagtatcattagtcattacaggaatacaaactggaaccacaataagagattactacatacttattagatggctaaaattaaagactgtccatacaaattgtttgtaagaatgtggaggatctgaaattctcattcattgctgataagattagaaaatggtgcaatcatttaaaaaaaaaaaacagtttggcagcttttaaaaatatatggaaaaaaaaaagaaatacctaccatttgatccagctattgatttgtaggtatttacgcaagtgaatatatagcctatagtcatacaaagatttacacataaatgttcataacggctttattgtaatagcccaaaactgtaaatgatccaattctctattagcaggtgaattgataaacaaatagtagtatgtccatacagtggaatcttattcagcaataacaaaatgaaccacttacacaaacaacaatgtagataaatctaaaaataaccatactaaattaaagaagccagacaataatctttatatattacatgattccatttatctaaaatttgagaaaatgtaaatcaattaatagagacagcaagcagatcagagtgattccctgtggagggctgcgatgaagttggagggagatatacatagatggagggtggaattacacagaaggagggagggattgcacaaaagcaggaagaatcttctggtggggggtgatgaatatgttcactacactaattgtaatgatggttcttcaggtgtacagatctgtcaaaacttctcaagttttaactttaagtacgtataattgatatacatcaattatacctcagttaacaatgaaaataaaaatattaaaccttttaattctaaaaaattacattcatatgttgggctcacatataaaaccagtttgatcttataaaaataactggacattatcctgtagctttactctgaaggagtatttccttatgttcttgtctaatttaaaataaatttctttcagtcttactgaggtagagataaataaaacagcaaattaactcctctgtctaaaaatgcccattactgttttcttctaaacaatttacttttcattagtaatcagatcccattttgacaatagtaattttcattccttttctctaagccatagtttccttgttcattcaagggtacattagttgctagaagatcttgtctaaatcctggaggaaaataattgacatattctaattcagtgattctcactggagtctgagaatctgggctaagcaaaatttatatgtattacttggagaagtttgttaatattatcagtacttgatccacacctttgtaaatcctaaatcctatcaggagtgaacaatctttatttcttaaaagctttcgtgtgttgatatgtaatgcatggccagtcttgggaaccactggatgtttctgaacagtaggacttcctaagaagcagtaagaagtagaaaaattctgataagtggatttacatcaatttataagatcaaggaaatacgtataccatatacatttcttcaaaggagagactcgactgtgattaacaatttagatcagtttacttctcaaagatagtaaaaagacttgtttccttaactacagaaggaaaaggggaatatgggcacttgccaaagagcccaggcaagtgtaaaatgaagtggagaagagtaaatgtttctttagtttatatcctgatagaagcatataaaatataataatatgttcagactataattatagaaattctgactgatatcacaattttaccccttgccattcgttactccctaaaaataaataacaatctgaaacagctacaaaatattggcaaaacatagttatgtcttgttttggcatgaattatttagatgatttctgcaatgctttacttaatttagcttgaaactaagaatggtttcaatcttaggctaaacattggggaattacttttgcagccaaagctcacagtcttgtcttgcattccaatagcatttcccctcccaactacccacccaaatctcattagttcccaaatcatattttagtgatcctatcaaggatcactgtatccaaaatcccttctggagaattcactggagaatgattagaatttaatgacagaaaggctagcatctctttcctcagagaatttccacactgcaatcaagcaagaaggccagggatttccattttgttaatgtgtttgactagataccctgaatatctttctattgtaaagcacctaaaattatggataaaacattgaaaaacaaatattacaaatggacagctaaactctcaataaagtaaataaaatatttatgtttcagattgatgatgagatggaaaattagagcgataaatttaggaggtgatgctgcagctttactctcagggaagaaagaaattttagtagcttggttccaatgttcacattagaatagaagatgaagtagagagtgctgatagtgaattggaactgagtttttcaggtaaagcagaaagtgctagatctgcaaaagtgctagaccttcactggaatgacagaataagaaaacataattttcctgctggcacagtaagacaacttaagccagtcgtggtggctcacacctgtaatcccaacactttggaagactgaggcagggggatcacttgaggccagaaatttgagaccaacctgggcaacatgtagataccttgtccttacaaaaaatacaataatgagctaggcatggtgatgcatgcctgtggtctcagctacccaaaaggctaaggtgggagaatggcttcggccttggaagttgagggtgtgtgagggagatgtgagggtgtggaggcactattatgccactgcactccagcctgggtgacagagcgaccttgtcacccaggctgaagtgcagtggcacaataatattgtgatgtgtatatatatatatatatatacatgtaagcttgtttattgtgactcggtctctgggtaaagagtaaaaaacatcctccttagaatttgtaatcagatgatattgaggttctatatcacatgctctgtgtccatcttcaattcctgctacagctgtagtagagactttctatgcctttagtggagtcctcaactcatgtaactgtcccaccccccagcttttctctaaagcccataacacatcttggacaatcctcaatcaatggaggatgggagttaggaaaaacatttctcaactcctttccaaaggaagattctgagggatacttgatattgtttctgagaacaccccagaaggattgagccccatctccctccagcgatgatgacagctcagtagcatactctttattggtatcatgttcttccctgcctcattctgaattactgagacccccctcccaaatatgccacctatacataagtcattgtatcaagcaatgctttcaggaaaatacaaattaagacaatgcatttcatgtcatgtgaatctgggcttcatttttttttcaattgtctataagatgtgggcatcctcaagctaaaatattggtgtcaaattatacttagatcagtggatcccctcatgcatctgacagaaacaaatgcaagacactctgatggtaaacactctaaaaccaaaccatctagtgtcattccaaataaaactcttccaaaatgagttcaaaatacaaaatggcaaaccaggagaagaaataatccattcaaagcagtatctagcactaaagattgtgttatttaactgttgcttagtggcttaaacaacactaatcatattatctctcagtttttaagggtcacacactcagtgcagatgggtgatttctttccacttccacattatttgacgtatcagctggaagacttgagggctgactggtttgaattatctaaagaattgattggggatgaagaagctgcttctaatgttatttcacatggctggagaatcggtgcttactgttggcagtcagcctgagttttttctccatatgatcttctctacatggctacttgagtgtcctcagaacacggtagctaactcctcccaaaatgagaaaaatggaagaccagagaggaggctgtaaactttttaatgacctaattcttacatcacacactttcacttcaacaatattctatctgtcatatatgtaagtcctattaattgtgggatggaattagataggagtgtgaataccaggagccaatgtttactaggaaaatattgaatgttggttactacagagactatggtggatttgtatcatgccaaatgaactaaactggaattgcattccccagaattcccctccaagcatagttctttggtattagtccattttcacactgacgataaagacatacctgagactaggcaatttacaaaagaaagaagtttaacatggacctacagttccatgtggctggggaagcctcacaatcacggcagaaggagcaagtcatgtcttacatggatggctgcaggcaaagaaagagagcacttgtgcagggaaactcccccttgtaataccatcagatctcatgagacccacccaacaccatgggaaagacctgcccccgtgatccagttactttccaccaggtccctcacgtaacactcgggaattcaagataagatttgggtggggacacagccaaaccatatcatctttgttagtgagggccatgagagatattttgtatgagagttggaaggatgaaatgaaacagcatctatattctttttattttcagaaagtcagcactgggcacatggcactgttgtagctcacacaggtgtcatttatctgtgggatcacattgttggagtagggcagtagctgggccctcagaaatgccacagctgccagacacccactttcaatcactctgactttcagtgaggtatggtttagctcatagcagctcctcctgcagattaccccaactttaaagttggacacatggaagcagggttgcaactctgtcctgatagattcgggtttattcttgcaggtaccagtttgtctcgcttccctcattttacgtccattttatctttcagactgtgtgcgctgatgactttaggctcagcactagacacagaaacaatagtttcacaaagacttttcaacagtttccacaaatatataaggcaaatccctattacaaatcccttattatacacaaatctggtggtactgcttctcagatcagactctgacatagagactataaaataagtagctttaaattgaatgaagcaggaaagaggaaatcaattactataagagataaggtgacataaaaagcagatatatttgaaaagaggccaaatagaagttataaaatgaaaaatatattaaataagaaaaaccttctaatatatagatttatatatatataatatatataaatcctgaacaggatatgggtggctttgacaaaattccacataaacagtagttcagataagatagatgtttatttctctttcttttttttttttttttttgagacagagtctcgctcgtcgcccaggctggagtgcagtgatgcatcttggctcactgcaagctccgccttccgggttcacgccattctcctgcctcagcctccggagtagctgggactacaggtgcccgacaccacgcccagctaattttttgtacttttgttagagacggggtttcaccgtgttagccaggatggtctcgacctcctgacctcatgatccgcctgcctctgcctcccaaagtgctgggattacaggcgtgagccaccacgcccggcctatttctctttcataaattgtaagcatttcaggacttcgatgatagataagacatttccacattgtcaacaaaccagatcctttattgtaacttcctcaattagctttttaatcagagtccagcttggatgctccacatctgccatgtctgcacccccacagtgaaggtgttactaggttggtgcaaaagtaatcacggtttttgccactgagagtaatggcaaaaacagtgattacttttgcaccaacctaatagtttaggctgctgtcacaaactactataggctggtggcttaaacaacaaacagttgtttctcatagtgctggaggctaggaagttcaagataaaggtgctggcagattatgtgtctgttgaggctcacttcttggtttatagactaccaagatcttattttcatatgaagggaagagagctagctactctatggcctcttctcataagagcactaatcccatccatgagagcactaacagtattacttcatcgactctgaaaggtaccacctccaaacactatcacattgagatgagggattacggtttcaacatatgaatttagggggccacaaacatacattccattgtagtgggaaagaagaatgggaagacctactcttttccttttaaaactgtgatccaaatgttgtacatcaatttcacgtatataccatttaactgacccaaagtagctgcaaaaagtgctgaaaaatgttatatttaggtaaatggacacatattcagctaaaaatagcattactacacgaaatatatggatattgagaaagcaaataatagactccgacacgatgattaaaaagcagataattctcaacaggcaattaacagagagaaagagctgaggattttacagttactaaaagcaagtttaagagataaataagataatagattaaaatgggatagattcaatgaaagaataagagggaatgagatggtaatgatgattttttcaaaatcaatagcatgaacctaatatttgagaagcacactggatctgctgcaaaataagatgaaattacacacacacgcacagacacacacacacacatacacacacacacacacacacacacacacacagtgctaaaaccaaaaccaaacacccaagacataaagatcttcagaatcaacataaataacttatgaggaaaactactagcttctttataaaatctacatttcaatgcactgctgtggttgcagggaaataagtaaatctccaagcaccccttaaataaacaacctaataaacatgcaaaaaatgacctgaatcctgagatagaatcaaagaacagtgcgctacctgcaagacacaaatgggaaagttggagctagcctgagacaagtgttgaaattagcattgtgttccagagactaagcttgagggagctgatcctggaaacctggcattatgtcagcaagcctggtcccaggtcttactacatcaaactcctagcagagataatttcaaattctaccctggagaaaaagttgaccctaggatacctaaagattaagattaaagaaatcaagccatggtgagtgagacagcagaaacaacaaatagcaaacatctaattaagactcccaatggcttcagatatagaaattatcagaaattgaatgtaaaatgctatatatgaaatgtttaaataaataataggtgaaattacaaaatcagtaaacacgaaaatgtcaagaatgaacagacacagaattttacttctggccatgctgattaacagagacaggagctttcctaacattataaatatctggaaaacttggaaaatgtatgagtcaaattctttcagatataggagattaggcaatttaggattatggtccaagggaagtggaaacaaagtgagctctattaactgcctggaactactttccaacctgtggtgcagagggggtcactagcatgatctcactgagttgagtaaacagagatcagagttagggaagactgacttacctggaatattgaatgtgtaggacacattaccagtgagaaggaaagtaggtgaaggaggagctccaggaatatgcacaggggtctccttgagaatgttctaggtactaagttgtacatgcatgggaaaagtcaaagggctgggagctttaagctgaaggactcccagagctcaggtagggcggggaaatgtttacttctgaaccaaccagaatagattgaacatctacaacattcagtggaaacatgagaaggttcaggccttagtataagtgctaaagtagtcccgaggtaaagaattctctaagtccagcctaaaaagcttaaaagcaaacctctaaagaatcacactgatccacaattacatacttacttagccaaatgaaattgacatttgtaaaaggatggcaacaaaatccaaacactcaacaatatagctctcatagtttggggccaaatttaaaattactgtatatgagaagaagcaggaaaatgtgagccatgaccatgagaagaatcagtgaagagaaacagaaactgaaagaattggtggatttatatgagtagggcttcacaaaagctgttttaaatgtgttcaaaaattttaaaagaaacatgaataaaaatagatatggaaggtataaaaatgaagcaaatgcaaaatttagaattaagaagtaaaatacataaaataaaaaagtcctgatttttaatagtagccagacactgaagaagaaaatgtcaatgaactcacacatatgatatgaaactatccaaactgaaacacaaagaaaaataataaaaagccactgaacagtctcagtgatgtgtgaagcaatttcaagtggcacagacattacgtgattgatgatataaaaacgaagatgtaaaaatatttgcaaaaataattaccacaaatttgtcccattttgaattaaactatagacaactaagttttcaaaacttaacacacctttgccctcatataaagaaaaagataatcacagtgaggcacattataaccaaattgttgaaaaaatcagtgataaaagagaacaccttaaaaatagctaaagaaaaattacacattacttactcaggaaccaaaataagaatattggcacatttctcatctgaaatattacaatccagaaaacaatgaaagtatatggtttatatttatgtgggtaaatgcattgtttctcctcatttaaaaatatttagaaattgttaaaagcaaacagattataacaagtggaaataaagggaatgtcaacaataacaattgtaacaataaaaggatgaggaggccgggcgcggtggctcacgcctgtaatcccagcactttgggaggcccaggcgggtggatcacgaggtcaggagatcaagaccatcctggctagcatggtgaaaccccatctctactaaaaatacaaaaaactagctgggcgtggtggtgggcgcctgtagtcccagatacccgggagtctgaggcaggagaatggcatgaacccgggaggtggagctggcaggaaaaaaaaaaaaaaaaaaaaaaaaggatgagaggtaggaagtagaagcataaaattgtaagattcttatgttgtaagtaaatatatgatattagtgtgctattattcaaatacataatatggtaagtttgtaaacatgagaagaactacaattcacccttgaacaacttgacccccatgcagtcgaaaaatccacgtataacttttgactcccaaaaaacttaactgctattagccttctttagaccagaagccttatcaaaaacataaacaattgacgcatattttgtatgttacatgtattatattctgtgttattaacataaattaagctaaagaaaagaatatgttattaggaaaatcctaaggaagagcaaatacgtttacaatttattaagcagaagtggtccatcataaaagccttcatccttaccttatcagcttcaccttgagtaggctgaggaggaggaggaggaagggaggggttgttcttgctgttttggggtggcagaggtggaacagttggaggaggtagaaggagaagaaggagagaggctgatgcactcagtgtaacttttattgaaaaatatccatagacaattggacatgcacaattcaaacttgtgttgttcaatggtcaactgtgctacaaaatcaaaaagtggggcatagttactaagccaatagtagaaataaaaaaaattacttaaaaccacaatatcagttcaaaacaaggcaggaaaagtgaaaaaatcctaagtaaacagtaatatataacatgttaatagattgaaaaattcaatattgttaagataattttcttgcattaagctgcagaacaagcaaaataccaattaaaatctcagcaggacttttgtagaaattggcaagctgattataaaatttccatgtaatacaaacaattttaaatagcaagagtgattttaaaaattaagggcaacgttgaagaacttacactactagatttcaagacttatcatacactgcagtaatagatggagtggggtattggcataaggacacatatttagattaaaagaataacataatctggaaatgtttacaagcatatatagtcagttgttttttttaatcaaatttgccagtgtaatttaataggaaaagaatggtgctggaacaatagaatatcaacgtacaaccactgacagcgattataaccgtaaaatttaggtgttttgtggttgagggcatgatgggacatctacaaaataaaggacaaaatatttcttactgcactgcaataagatggaagtacaacatttggtagtcctttttggatacaggaggcagcatagttcacatctgaggatgctgtaccagaccatgtattaggtaatacaaatgtttgcattcattagtgcacactaactatggtagaagtgctgaagcactaaaaaacttagttggcaatgatttgtccagttgatagcaacccatgtttgtcggggttctctagatggacagaactaataggatagtgtctatatgaaggggaatttattaggagaaatgactcacaggatcacaaggtgaagtcccaccattggttgtcttcaagctgaggagccaggaagccagtccgagtcccaaaacctcaaaagtagggaagctgatagtgcagccttcagtctgtggtggaaggcccaagagcccctggcaaatcactggtgtgagtccaagaatccaaaagctgaagaacttggagtctgatgttcaagggcagaaagcatccagcatggaagaaagatggaggccagaaggcttagccagtctggtctttccacgtgtttctgtctgcttttattctggccatgctggcagctgattagattgtccccacccggattgattgtggatctggctttctcagtccacggactcaaatgttaatctcctttggcaataccctcacagacacacctaggaacgatgctttgcatccttcaatccaatcaagttgacactcaatattaaccatcacgcaacccaagtgtgagcatgaggtgcatgtagacatggtaaccatggtgatgtaaggaagactatgcataaattcagtagcatgggttccctgtctccaacacaaatttatctcctgttactgcatgatgtccatacatacaagacaatcactgagtccccctaatagcaccattctgcgtggagaccaattagctgctgggtggtgcgtagtggaacaatggcatgttaagttaaagatttcagtgggatgcctagctcagacatgagaccatacaaagatgggatgtcactttttaggatgtgtattctaaatcaacaaccataatatgattttttccgagtaggtaaaatacatgagtctaaaatcagggacttaaaatataaataacttacttaacatcatcaccagtttctcatttacagagtttgtgctttccagacccacaagtttggactgtatgatggagaagttctggtcgacaaaggtagaatacatcgactctgggacactgcaaaaatttcaatgaacttaagttatggcttcttccagtgtacttcaggggacttttcccaagtgacttgaagagaagtcactatcctgatagggataattgatctgaacttcggaaaaaggtagagctcttgtagaacgtaaagcaggaggaatatttttaacagtaactaatcttaatccactttggtgtcttttgatattctcttgtacaactttgagaatcaatgtaataatacagcagccaggacctgagaaggcatagcgactgtgactatagaactgtcacagatgaaggtctgagtcttccaaagttaggccacctgaccagcagaggtgctgtttaagggcgaagagggtgaaaatgcgtaactaagaagtatcttagctcaggcctctgtaaaaaatactgtgggtgggttagacaacaaaactttatttctcacagttctggaggatggaaagatcaaggttgaggtgctggcagtcagttcctagtgagggccctcttcctggttatcagatagctgccttcttgctgtgtcctcccatggtggggagagagtgagagctttggtctttcacttcttataaggagagcaattccaccatggggcccccacctctatgatcttatctaaacttaactatgccccaaaggctcgtcctctaaatgccatcacaggggaagttaggggttcaacatatgaattttgagggatatgacattcagtttacaacaaggatggtaatgttgaatatcagttacagcccaagatctactgcagagttggaagctgtgtggtttcttcatttaataagtctccactagagaaagaaaaaaatacacacatactagaatcatggagaagctgctcccaacatatatgtacacatggattcgagcagcatggattaactgaagtggacactgtgcttcactacccatttcctaagctgcttattatataaactgttggagtgctgctgcctaatagaactgccttcctggaagtccttcatcttttcatcttttactgaagcatctcacatccaatactggtggatacaggagtaaaaagttctggtccggttgcaataaatcagagaaatgctaaaaagttatcccagttccagaactctaaaagaagcttttgttgtgaatgaatcaaaatccaactttttttttttttttgagacggagtctcatcttgtagcccaggctgtagtgcagtggcatgatctcggctcactgcgaccttcgcctccggggttcaagtgattctcgtgcctgagcctcctgagtagttgggactacaggtgtgcaccaccacacccagataatttttgtatttttagtagagacagggtttcgccatgttggccagggtggtctctatcaaagtcaaacttctttgtctttcaattctgcttcctttcctttccttcctggtgttaattccaagaacactacccaatcaacctactgtgctatgttttacctatagtctgcttcccagggagcataacttgcaacattaaaaacttgagaacaaacatgtaaaagtgaaaaatcaacaaagcaacgaattctttgaaatgatgaatcaaagtaataaactcctaggaagactgatcaacaaacacagaaagcacaaatttaaaatatgcagaataaaagaggatatcactatagaccctaaagatgttaaaatataacaagaggatattataaacaatattatcccaataaaattttcaacttatataataagaatatatttcttgaagaacagaatttaccaaaacagacattagaataaacagaaccgtgaaaaactttgctaaaaattttgaaaagagaaaaataattaacaaatacatagataaatataacttaccaaaatttataaagaatggctttaagtaatcataaaataatttaaagaaaacaccaggctcaattcttgtatggtgaagtctgccaaaattaaaaaaaaaattaaattctatggacaaattcggaggataaaaaataaatataggtcagaaactcagatctacaaacagaaaggaagagcatttttaaaaagtgaagctaaaagaaagacttatttttcttattcttaagtgatctaagaaataatgattagttcaaaatattaatcacaataatgtactttattatgtatgtgtatatgtgcatgtgtgcacatatatataagtgaaatgaatgacagtgatgataaaagagatgagagagaggaattgggatatttaaaaattattattataaggtacttgcactaaccatgaagtagtatagtgttatttcaaagtggacttgtaaatgtatatttcaaactctagggcaacctccaacaaacacgaataaaagaagtaaaactaatgctaagaaaggagagaaatggaattatataaaatgttcagttaaaaccacagaagtcagtaaaaaagtggaagacattagactaaaaataaagggagagagaaagacatgctatgatctcactaataaaaaagcaggaatagctatattaattttagactgagcagacttcagaacaaacagaggtatgagaagtaaattagtacaaccattatggaaaacagtatgactagtctgttaaaaaaaaaaaaaaaaaacctaggccgggcgcggtggctcacacctgtaatcccagcactttgggtggccgaggcgggcggatcacgaggtcacgagattgagaccatcctggctaacacggtgaaacccctctctattaaaaatacaaaaaattagccaggcgtggtgatgggcacctgtagtcccagctacttgggaggctgaggcaggagaacggcgtgaacccaggaggcagagcttgcagtgagcggagttcatgccactgcactccagcctgggcgacagagtgagactccgtctcaaaaaaaaaaagaaaaaaaaacccccaaaaatgtaactagcatatgattcagcaatctcacttatgaatgtatatccaaaagaaatgaagtcagtatgtcaaagggttatctgcgctttcatgtttattgcaacattatttgctaagacatagattcaacctcaatgtccaccaatggatgaatggataaagaaagtgtggtacatatacacaatggaatactattcagccttataaaaaagaaaaaatatctgaaacaacatagatgagattgaaggaagttatgataaatgaaataagccagacacagaaagacaaatatggcatgatctcacttatacttggaatctaaaatagctgaaatcatggaagtagagactacaataataggtaccagaggctgggtgggtgacggggatagagaaaatgggaagattttaggcaaaaggtacaatgtttcagctaggaggaatgtgttgatatttattgcacagcagtgtgactatggtcaataatgtattttgtatttcgaaataactaagagagtatatttcaaatgtctcaccagaaaaatgatggataaagtaggtgatgtgtatattaattagcttgatttaattatttcacatggtacacacatatcaaaacatcacattgtaccctataaatgtacaattatgatttgtctgttaaaaataatattaacttaaaaggaggagcattgcatagtggtaaaggggttcattcttccagaagtcataacaacctgtaatgtatatgtgcctaaaaacaaagtatcaaagtatggaaggcaaaaactgatggaactgctaggtgcaattgatgaatccactgttttagttgaaggcctcatccttctatcacaaatggacacatccaacaagcagaaaataaatttaaggacacagttgaactcaatagcatcatcaatcaactgaatataattgacatctatagacctactttatccaacaacagcagaatacatttcttctcaagctcacatggtaccttaactaagatagaacacatgctgggccataaaacacaccttaagaaaaattttaaaaaagaatgatgaattgtctgctctcaagccacaatgtaattaaactagaaaacaataacagacagataactggaaaaatctcagaataacacatttcaagataacatataaataaaaaaaagttaagaaaaacaaaaaaagggaataaatgaaaatgaaaacactataacatttgtgagatatagtaaaatcaggtcttagaatttatagcattgaatacatattttagaaaagtgaggtggctcacacctgtaatgccagcactttgggaggccgaggcaggcagatctcttgaggtcaggagttccagaccagcctggtcaacatcgtgaaaccttgtctctactaaaaatacaaaaactagctgggcgtggtggcacgtgtctgtaatcccagctacccaggaggctaaggcaggagaattgcttgaacccaggaggcagagattgcagtgagtcgagatcgcaccactgcacttcagcctaggcgacagagcaagactccatcaaaaaagaaagaagaagaagaagaagaagaagaagaagaagaagaagaagaagaagaggaagaggaagaggaagaggaagaggaagaggaagaggaagaggaagaagaagaggaagaggaagaggaagaagaagaagaagaagaagaggaagaggaagaagaagaagaagaaggatctaaaatcaataatttaagcttctaccattggaaattagtaaaataagataaaatttaattcaaaataagcagaagaaaagaaataatgaaaactagagcaaaaaatcaataaatttgaaagtaagatatcaatgaatttgaaagtaagatatcaataaataaaatcaatgtaaccagaagctgattttttgcaaggtaaataaaatagataaaatagataaacctctaccaggccaactaaaaaaaaaggacaaaggacacaaatttttaatatcagagatggaagagggaatatcactacaactccattgacaacaaaaagatagtaaaggcatactatgaacaactgcatgcccataagtttgataacctagatgaaatgcatcaatttcttaagtaacaaaatctgccaaaactcacacaaaaaggaatacaaaatccaaatagccctatatccatgaaagaaatggactcaataattaataaccttccacaacagatagcatcaggcccaaagatgttcactggtgaattctaacaaagactgaaggaagaaattataccaattctctactatttatttcagaaaatagaagtagaaggagtacttctcaactctttctatgaggccaacatcatcctgatatcaaaaccagacagactttataagaaaagaaaactgcagattaatatctcttatgagtacagatgcaaaaaaaaaaaaacttcaacaaagtatttgcaaatttaatccaacaatatataaaaagatttatacatcagaaccaagtgggatttatctcagatatgcaatgctggttcaatatcaaaaatcaattaatgcaatccattgcatcaagaggcttaaaaagtcgtgaaattgtatcaatagatgcggaaaaggtatttgagaaaatccaacactgacatatgacaaaaactctcagtaaactgggaagagaagaaatcttcctcaaattgaaatggaatatctacgaaaagcctacagcttaacatcatctttaatgatgaggacctggaagctgtcccaccaaaatagaaagaggcaagaatatttcctgtcactactgcttttcaccattgtactcaaagtcctagttaatgacataaaacagaaaaagaaataaaaggtatacagattggaaaggaaaaaataaaactttgttcacagatgacgtaatcatttatgtagaaaagcctaaagaattgaccaaaaaaccctcctagagctaataagcaattatagcaaggttgtgggacaaaaggttaaaatacaaaagtcaatcactttcctatataccagcaataaaaatttgaatttgaaattaaaaacacaatatcatttatattagaacctacaaaaataaaaacttaggtgtaaatccaagaaaatatatacaagacctgtacaaggaatactacaaagctatgatgaaaggaatccaagaactagagtgacaatccacgtccatggacaggaaaactcaatattgccaagatgtcagttcttccaaacttgatctgtaaattcaatgcaatcctcatcaaaatctcactagtcattttgtagatattgacaaactgattctaaaatttatatgcaaaaggaaaagaaccagaatagccacgacaatattgaaagactagaacaaaattggaggattggtagtattgacatcaagacttactttaaatctacagtaattgaggtagcctaatatttgcaaaaggataaacagatcagaggaacagaagagagcatgcagaaataaagctacatgaatgtactcaactaatcttaaacaaaggatcaaaaacatactatggagaagatagtcccttcaacaaatggtgctggaatacctggatatgtacatgcaaaacactaaatctaaatgctaaccttatacccatcacaaaaatcgattcaaaaaggttcaaaaacctaagtgtaaatgcaaagctataaaactcctaaaagaaaacataggagacattgcagatgagcctggatttgctgataactttttatatataacagcaagggcataattcatgaaagaaagaattggcaagctgaacttaatgaaaattaaaaatgtccactctgtaaaagatattgttaagataatgaaaagacaaatcatagactgaaaatattcgcaaaagacatatgtcatgaaggattgttattcaacatatacgaagaactcttaaaacataacaataagaaaacaatttttaaaatgggcaaaagacctgacaccttagcaaatatgatacacaaatagcaataagcatatgaaaatatgctccacatcctatatcatgagggaaatgcaaattaaaataaagaaattccactaaatgtctattacagtaaccaaaatccagaacattgacaagcaccaaatgctgatgaagatgtggagcaacaggtaccttcattcattctggggggaatgcaaaatggtatagccactttgaatgacagtttagcagtttcttacaaaactaaacatactcttatcctacaattcagcagttatgctccttaatattaacccaaaggagctataaacatgtccaagcaaaaatctgcatatggatgtttaaagcagcttcatttattattgccaaaacatggaagcaaccaagttgtctttcagtaggtaaatgaataagtaaactgtggtatatccagacaatataatattatttattgctaaaaagaaatgagctctcaatccacgaaaagacatggaagaaacgtaaatgcatactactaaaaaaaaagccaatttgaaaaggtacatactgtatcatttcaactatatgacactctggaaatggcaaaagtattgagacagtcaaacagtacagtggtttctaggtgttgaggggagggatggatgaataggtgaaatacagagcaaattcagggcagtgaaaatcttctgtctgatactataaagatggacacatgtcattacaaatttgtacaaacctatggaatgtataacaccaacagtgaacaataatgtaaattttggactctgggtgataataatgtgtctgtgtaggttcatcagtcataagaaatgtaccacattggtgggggatgttgataatgagaaacgctatgcatgtgtggagacaggaggtaggtacattgatgctgtgacccttcctctcacttttgctgtgaatataaaactgttctaaaaaaaatactttaaaaaatccatggtgaagaaaattataaagacaggctattgtttcttgtttgttttacaaccctgtgctttgtgcaagagaaaaagttgttcccaatgagccctaggtcctagtcagggccacaaaactgtcacatcccccatggggtgggccaataaaggctgacaatagtgttggaacaagtgaggcaatgcaggcctttatgtatactcatggtttttgatttttattaacttttattacctttttcgatttggttcaacaaatgaaatttacagatattttacataagtgtatattgcagagcccatttcttcttttgcatcaggctcagacatggcttgtcatggcactgaggaagagatttattcttcttgactctggggtttcctagtcctttctatctccatgatgatggcccaaatgaactgaacttccctagcactgtctctgcacaataacctcatgggtcttcattccctaatctgacttttaaaggcctgctgagtaaagaaataagatcctagggaattctgaagtaggcgaagatgtttctgtagtacttcaatttccaactttacatcattttcctttcaaagtatgcccccattttcactcactaacattcatagtattttacctttttatcatctcaaaacatttgagaaatttgtggaataaattaactcattctgaggtaaaaaaaatttaaatcagctgagtgggctctacacactgcacagaaatagtgtctgttttacaaaaattaaaattttgctagctaaaataaaacactagctgttaaatgtcaagtattaactcatgggtgaagaagtgaaacctttcaatagccctttaaaattttaacaattacttcttaaactacgcataaaaaccagttttaatatatatataacacaaaaaaaacacagaacaactttttcaaaaaggtcaacagttttagttacaaaacaatgtctctggatgtggacattaaaaagactacttccaagaaaattaaatttttgaagtcttaattaaatccaaaataggcaatgtgtgccaacactacaaaagacatcaaaagtctcatctgccaaatgttgcccaatttgagtacagatttcatttcctatgtgaatgccatgtcctattccctgaaacctgaatgactaacattgaaaaatataagaaacataaagtgataggtattatgtgcagattttattaatagcacaacaaataatctttagtgaacaaaatggacagtttccatgactgaatctcaagaattagaattagaatgactggatttataatttagatacactggctttttacttggtgacttatttaggtagttacaataattgatattttctaagcacttaacatgttccaggcatgataataggctgctaatatagtttatttgtttacttttcacaagagtcctatttaatctcctttcgcatatttttcatatgagaaaactaagtatattctaagattatggaacttgcccaagtttacacagggatgtggttcaggacgtgctatccaaaatacagcaccttgacacaatgagtattttaagctgaaggaattgatcaaaccacagaaacaggaagatgtctctgaagcaggatatagaaacagttaataaaagtaattcaccttgaccttgtctcctgaagcagaccataaaacctagctgagcttcccctgaaaataggtcataagactcttatttcaggggatttttgaaatatacccagaagaaaggaatgtcacacaggaacaccaagaaaaatctgaaggggagaaaatataaatattttttctgagtcctcacaaggtctttgctaggatacctgtgtaaaaaaaaaaaaaaaaaaagacaaatgaacaggaacaaaaaggtatacaaattttactaacatgtatatagatataggagccatgcactgagtatgagactcaaaggaagtgccagatagctgaagtttttgtaccatcttgaggttacagaaggaataggggaaagataggatatgggagggagagaggaggaaaggcatggtgagcaaaagcagacttgttattgcagaaatctcacagatagcaactctcagaaagaatacatggtggcctgcagtaacatttttctgtcaaaacttctttgaaggtataagattttagtctctttttctgtgagttaatctttcctggatccggataagaggaccctcagaaaaagtctgtttgcgttgctgtatttttttactaatgcagattttctctataatgcaaatctcccacacaaaagggcaattttttcaggggtatttctgtgggttgcagcccttcagaatagccatatagaaatacaccaaaaaagtatattttgtggtgaaatattctggtttctgtcagaacaaacaggtcttgctaaattttctcccagtttatagctattagatcatatcttcctttttcccaatcatgttcctccacaactgtctacttcttcatcatgcttagcataaaatatacacagttttccctgtttctttgggaaacacagttttcccctccgaatatacacagttttcacctctgaaatttccatattacgtaaaatttatattaaatacgttgtatggttttctcttgtaatctgtcttttgttacaggagtcacagtcatgaacctagcgatgggcgaggaaaagaaatagctttttctcctctacagtttcacagatagcacatgcagaaaagccggtgagacacacatattcagctggagaaaagacttgacacatcactttttatttatttattttgagaaaggatctcactctgtcacccaggttgaagtgcagtggcacaatctcgtctctggtagagacagggtttcaccatgttgtctaggctgatctcgaactactgagtccattggatccacccaccttggcctcccaaggttctgagattacaggcatgagcaactgtgtccagctcataccacattcttaacatatgctactacattctttactcaccagcttatagttcactactatttttcctctccctttctcatttgttaatttattaattttccatgacttgggaggcaaaacttttatgtaacataatagcaatctgtatccctttaaaaacattggctgtttttacacgccatgtaaacctcagtaaaatgagtaccttagagaattatatagattcctcagcaattccaagagatccaatatcctttccctgttgcagaccagaactttatcaggctacttaggtatgaagtaaaactaccagttcctgttttccattaagcagagcaaacaataggcaacaaacaaacaaacaaacaaacaaaccagaattcaagcttgttgaagcaacaatagcaacggaacaaataataatatgaaatttcaatacagaattctgtcaaagtttttccttctactgttcacaaaaatgttcaccaaaacatcaggcttactgacataggacaaactgcataatgcaatatgttaaataacaagcattgtccattataatgaaaggaaacaagagtcaaaggcacgatattcataaaacacttggaatctataacccactaaaattcaggctaccagccaaatattataacatcttcaaacatcaggtaacttaaggtgtatgatttgaaactgataacacataatttccaaagagctctgtataggtaaacagtggtgatgcagtgagctatttgtgtcgagtatttatttctttgctgtctaattgctccaactccctagacgttaggagtctatcacctgctgttcctcagctgctaagatcagagaatataacacagatggagtgagctatgttctcacggctgctgcttcacagagataaggctgcaggttggagaagtgctcagctctgccttcctctgaaagagcctgaacagctatcaataattcccagttactcctctaccgttatgttaaacaacactgccttgcatacacaggtgcaattagataaaagagagttgtttaaatcacttgaaatgcctgtagctttattattgcagatctttgtgttgtctctcgtcttttctttttttaaaaaacctctttttcctgcccactccctcccccaggtctactgccaaactgcaatgatttaagaacctggttaaaatattgggtcacatttcttcaccagttgccttgagcgtgtttggggagctattctttagccacccttgtcattctgctgtcattcacagcattatatttctaggtatgagaacattgcaaaaatcagttatgctcattcaggaacatgtattatgtctggatatgatctcacaattaaaataaaccaatttccagcagccagggtatggtagctgcaatcccttgtatcactgaaatttatacagttcttaattttatcaaaggacaaagatcattttacctccaactcctaaatatgcaaatacaaactctccacaccctctcctgacactggagagtggtagaaagggtcggactgtgctactaaatcgggcttcatataattcaccattttgatcagttatcataattgacatcagcttttgcttcctgtgaagcaacacatggaatgcacttagtacagggcctcctagcctattttcaaatatcaactactgctgattaccaatgtattttcggccctttccctcctgatatgtccttgagtatcaagttcagtggctgttttcccccactcagcctagatactctgggattctttgaaaataagctgatatgactttcattagtgtctccacactttaaaaatttatcacgaacactggtacaagtgttctttattatatagaaacaatgataagggattcattgtcacaagatttttaagcagtgaactgattaaatactcattgcttgggttaattttacatatttaaaatgctttttttttttttttttgagacagagtctcactctgtcgccaggctggagtgcagtggcacaatctctgctcactgcaacctcctcctcccgggttcaagagattcttctaccccagcctcccgagtagctggaagtacaggtgtgtgcccccacgcccggctaattttttttttttttgtacttttagtagatttgggttttcaccatgttggccagaatggtctcgatctcttgacctcgtgatctgcctgcctcagcctcccaaagtgctgggattacaggcgtgagccaatgcacccagccaatgcatatgttttttaataagtgtttctcatacttttccttaatctcctttatcgtactagcatcttattatttactgttgatacaacattctgatttcccctctaagcccaaggtaagctgcttcttactaaaaaccaatcattttagaaacaattaaacatgaccaagcaaagactgagctttatggtcacactctgttatgtaaatgaggtaatttaaaacaaacttagtgtttttttcttttatatttaagcttatattgttttacctagatgtttaagcaactctgccaaatgtacagttcacactgtatcataaatactattacaaatttattaaaattattttctgacatttatgtagtatatatgcatatatattttaaactttagtttaattaaaaggtgttaaataattagtaaaccttagaagtaaattattttccggattaatgaatttctaattttatataaaattcaattggaaaatagcactacagtattctcttagcagaccacatcttctgtttgctacctaagagataatctacaacctcaagtctctatggttgtgtacaattcatctgagctcatcaggcttactggagagtcaggtttccctctgtgatgcaatatttcatagactaagcatctttaccatttcccccggatgttcatggtttcacaccttggaatagtagaggccaccaggctcctctagcccatagtgtgtttccacattgacatcctcccagtggataccccagtcaacaaacaccagcagcaccggttatggcagcagtttattttagtctcctcgatgacccagaatttcttctttccttcagtaactggtacttctaggaaaaatacctctgagaaaacctccttatctcttatgatctcttggtagctacacaactcattattactttcttgactccatgttaaaaattcatgttaggcatgattttacaagcatttggtgtcctgtacaatgtcattaaagaaggagtatctgtaaggggaaacgtgagatattttctgtgaagttggaagacacggtactcaagaccatcctcactttgaataccagttgtatgtttgggggtttcccaagatcactctcagatttaacaagtcactagaaagacccagggaactcactgaaagccgtgatatattcatggttatggtttattacagagaaagaatatagaataaaatctgccaagggaagagatgcacagggtggagttcaatgaagtgggggtgtgggtgtttcaaatgtgaggcttctattattttcaggatgcattaccctcctgacatcaatgtgtgacaatatgcatagaatattgccaaccgaggaggctcctcagaactttagtttccagagattttactggaactctatgtttgactgcccacatggctgacctctagtctatggactgttggaggctgaatggataccatgtggcccaaagacgtcatcataattcacatgaacagcagcactatttcaatttatgacatgtaatatgtatggatcagtggagcttgtggttttcattgttctgtgtgtgtgagggtgatgatagaaaccatgaattattttgcctaatgacagtattttaatgcatatcttttgaatttagcaggccagtagattttttgttgattctcagatcagctgaggtctccctagcacctccgatttgagtttcagaatcctatatagataatattctagggaagtccattgactcagattttattggtttatagaaacatgattgtattgtatttatttggatttgaatataagtaaaatattttccatggtaactctttttttctaggaatatgtgatatctctctaattattcaggtcttgttttacatttttaagtagagatttattactttcttcataacagtcttgcagattaatgttgtttaacccttcttttatttgtattgtgggaaagatacttgtattcgtctgttttcctgctgctaataaaggcaaacctgaaactgggtaatttatacaggaaagaggtttaattgacccacagttccacgtggctaggaagcctcacgatcatggcagaaagcaaaggggaagcaagacatgtcttacatggcagcaagcaagagagcgtgtgcagggaaactgcccttttataaaatcatcacatctcatgagacttattcactatcatgacaacagcacgggaaaaacctgcccccatgaatcaattaactcccactgggtcccttccacaatatgcgggaattatgggaattacaattcaagatgagatttgggtgaggacacaacaaaaccatatcaacacttttacattacttttaaaaaatctgtttatttctgatattatagaactacagtatagagcagggatatggcataaggtataatatatcttgtcttgaatgttactgtattctctcataaatttgaatataatgttaatgtacctatatttctatgtattattaataataaaagctatcattattaacattccactactaagatgactaaattcttcaattttctactatatttcttaaaataataatataaataatagttgttcaattgggcatcatttctttgttctctgttaataaggggttttctattgattcatgatattcttcaatagggtaaatatcttgtgtcctattcttagtttgtcacatgattgttttttaaaaattaaaaatgcatactgatttcaaattattttttcatatcttaaaatatatttgtagttttcttttttaatctaataatatgtatttttattatttcctactttctcataacatttaagacttaatttttgtagaaaaattttagctgcattgtgtaatatttttatatgttgtattctcagttttgttcaattctagtttattacatactttgatttcctgtttatttgaataaatatttggaaatgtaaaacatttgatctttattccatttcttccttccctcctttcttcttttcttctcctttcaattttctaataccactttccaaaactgaacaatttgtgctaaatatttttgtgtttggctttataatgttgttggatttttaaaatccaaaacattgttatactggcaaacactatggtttgcttagttaataggtgttctccaattttgcataccaacaaaactccttgttttgactccaaagttcccagttgcagaggattcattatcattggttttggtcatagaaaccaatcttattctccttgataaatccttgctttcatgactgtcctggctgctagagctgggcatgtgacctagttctgtccaatgagttgtaactggagatatcctgaggaagcaattggaaaaagaatatcctcttagataataaggggataacagatggagatagctcctgcttcttctgcctcctgcccttgaataaaacctaactctgcagtggctgaagctgtgacaatcctttggtctcccagggaaaaacaagaaaattataatagaaacagcttaacgtctatatatgtaccaacttttcttgatgttagttgcagtcaggtcattaagttctgacgaaagatatgcaacttttgatatttttcctctttctagtttatcctgttgcatacagctctagctaaagcaattttttttaccttaaggtgaattgaaaatggaattccaaataaaaatgatgtaacaacaaaagaaaatgttagatatccaattctgtagggcatctttcagccatggttcatgtatctgaacttttacacagtaaataattaaatttccatatttttagccagtttttattttgaattttctgtcccttaaatccaaaactaatcttaactaatactggtgttgactcagaatcctgatttttgtgagatgagtaaggaaaagcgtgactgcttaactttaggttcttgttaagtgaaatattttcttacttcatggttggtttttctgttgcttataggaaaagtgttcactataaaaaataaagacttcacagatatagccatagatttgataattatccttatttgttatattaatttctctacgtgaggagaaaaggaactgccaataacctacagaattgatacttctggggtacattttgaagcatcatatttgaaaacaaacctactgacctctgttgctgattttcataggcagagcttttaaagaaagtaatctcccttataatatagcatttacatttccatatttcatagctataatatagttttatagcatgatagtacaatttctatttaatttgatacctgacttaatatatgtgtatgtgtatttatctatgtgtttaaattctaatattcaaaattgttccaaaaacacaattctgccctttgtgatatgataaagcccagatagaaagctcttaatttttgtcattcaaacatctacactttaatgcttaaataaaagctgtcatccaaatataaagcattctctggagatattacatattttaaagatcatggctagtggactgagtttagtaaattaatacgtaaaaagttaattctaagttaatttcataaagaatgtccaggggacaataagtagcttgaagaagacattgttcagaaaagtagaaagttgttgctttttccagctggttgatatttcagggtcattttgtattttaaaattgccagtctttctaccacttgaatatcttggagctgtgtatatgaacatagtcaactctttcattgccttgagcattgctggaggatattcaagctatttgctgatctctagctatgttttaaccaaactttattttataaagagtccctaggtgcaactatgaggcatttttatgcctcctttgattgattcttccagccatagccctcggtgatttggtaatactttaaatccttgcctaagttgtttcactattagataaccagtgtgtagacctgccagaatatttgtattcctttctctgtggccaagaactgacttaatgttccctgagagaatttcattgtttgatggccctcctcattctgttttctacggtctgtggttttacacaaaacttattatctttgaagttaggcctcatcttcttatccttctaatcctatcacctccagttttttttttcttagagatggaattaaaaggcagtcatacctgattttgaaactaagccccactagtgtttgactaaggctaagaaactgacctctttaccacaagttccataaactgcacattgtaaaaaataaagttgtgatgtaatagtgccagtcacatggtaactacttaataaacttcagtttatctctttcccttttactcatattgcaattataatttgttcttttgtattgaagaactaatggactttttaataataaatatagtcttcagtcaacatttattgcatatgtataatcagatttaatcaataattttttttattgtttttgttcttgagttaactggttgctaatttgtaactcagaacttttctgattaataggacaactatgcattttttaaataagaaatacatggttgaaatagagcaataccaatttgttactacatttggatgagtgtgcacatttttgaatttattgaataatagtaatttttatgattaaaccattcattagtactttagaatatattaacctggagttttcaaatttatattcaaggcgattgtatgttaaaatgcaaatattttatattcaggttttgtaaaaaatattgttttgcctctcttaagctttaaacattgatttaaataaggtctaagtaatcaatttattaagtgatcaatctttgtattcaacatgacttttatgttcccaaaactatcttaatctcacctagaattttatacttacacttcaggattcttagttccatagcaatattgttctagttttacatacaggagaattttgcttttaacttgtggtgtaaaaccatgatattttcttagcagttaaccatgtttgtttgttattttagctactgtaaattggatttatgcctgggatttagtaagcccaggacatagaaactgtgtgtgtgtgtgtgtgtgtgtgtgtttgtgtgtgtatatacatatacatatatatatatactatatatatatatatatagagagagagagagagagagagagtttttttttttttttttttgagatggagtctcgctctgtcacccagggtggagtgcaatggcgtgatcttggctcaccacaacctctgcctcctcggttcaagtgattctcctgcctcagcctcccgagtagctgagattataggtgcccgccaccacacccagctaattttttatatttttagtaaagatggggtttcaccatgttggccactctggtcttgaactcctgacctcaggtgatccacccgcctcggcctcccaaagtgttgagattactgtgtgagccaccatgcctggctgaaactgtctatttttctgagaaattccaatatcatgggcatcccaatatttttagaaaaattaaaagcttttattcctaaataagcttatagaaataaaaaaattgcaattttttaaaaaaattcaaaacatttttcattaatcattttacaaagatactactgggagaattagtccattaaaaataatgggtgatatcttcttcttccacttagaacatagagttgcaagaggattgtctcttcaatcctaaccacgcgaaacttaaagtcatagtttcttaagctcattagagatgggagcatgcaaagaaacctactaaattataacccacacagtgatttgcttagaatagaagtgatccacaaatgctttaatctgtggccaaacagctgaataatgaagaagccaccaaagctatgagcaagaagaaaacagttatactttcaatgagttgttaaagactaataacagactggtatgacagaatccctaggagacatagatgaaaaatatctgcaactatccgccaactctttcccacaagccttattgagctctcatgagaaagattgtgggcagcacaggagagctgagacagattccatgggaggttcaggtgtgtagggcctgctgaagtctgaggggaagaagtaggactgagagaaacctctggacacttcagatactcatcatgtggtaatgtgatgagcctgctaaaatgtgagggcagagcagtataactgcgagaaagcccttaggccatggtgccttatacttaatagggaaaagcacctctctgtgcctagagaacaggtgagaatgacttctaaaggtgcaaaggtacagagattactgaggtctgaggacaatgagaaaaaaaaaatggagggcatccctatatgcactctgggtctgacaataagcatgcagcagatgccatttgtagctgggtgtggggaaagaaagatgaaataaaactatcccaagtgcatgagcatgagatctgatgacatgaaaataaatggctcagacactcagatcccaagtttattaaaataaaggttctaaaactaccctcaaataatttgaaacctgtagggaactaaatctaactgaagcaacaacagagtttagacctaggtcaactataggctaggttgactcagaaggagcatgcccttttatagccaaaaatatttacgtcagcatctattttttttcacaaattgtccagaacgtaagcaaaatttattagacaaatgaagaggaaagaaaatgcttcaggagagaagcagtcaagagatgtgagaattatcaaacagggacttaaaaataactgtaataaaaatgttaaacggtcttaaggataggccagctattttaaagtaactatgtgaaatatgttaaatgaccttgggcaaaaagcagatgacaacaagcaggaacagatgggaactactagcacagcatatattataaagaataaggtcaacggaaaatgctagaaattaaaaatatggcaacagaaatgaataattattctgatcagctagcttattggaagactgcacagcagaggaaagaatcagtgagtcagtgaccaacaggcaagtaagtagaaactgttcaaattgaaacaccaaaagtaaaagagtgtattactccattctgtcattgctataaagaactacttgagactgggtaatttataaagaaaagagtcttaattgaattaaagttccacagactgtacaggaagcatggctagggaggcctcaggagacttacaatcatggcagaaggtgaaggaggagctggcacatcctacatggatggagcagaaggaagagtgagcagtgggagttgatacacacttttaaacaaccagctctcatgagaactcactcactaccatgagaacagcacaggagaaatccatccccataatccaatcacttcccaccaggctcctcatccaacactggggatcacaattctacatgagatttgagtggggacacaaatccaaaccatatcaaagagtaaataaaagaaaatggagcttgcaagattaaagggatgctataaaatacaaatattgaatataaaattaaatcataatatgaaacatagtcattgaagctcaagaagttgaagtaaaattgcacagaagaaactatttaaagatagaatagcaaatgttttttcaaaattggtattacatcaattcacaggttaagcacaatgtgtatgctgaaactgtacgtggacatatcatggtggaactgctgaaaaacaaaggaaaagaggaaacagtaaaaactggtggaggaaaaaagacattacattctttaaggtggaataacattgagacaattgctgatttcttaccagaaatgattgaaaccaaaaaaaattagaatgaaatatttatactgttggaaaaaaattatgcataaaaatttctatattcaaagaaataatcttgtaaaataaaggtaaaataaaggtatgtttaaataaaagctcaaagaatttgcagcaatgcatttcaagaaagactaaaataagttcttcaggctatagaaagtgaatatctataaatctaatacacataaacctagaacatcagaaagatgtaaatatatagaacatatttacaaaaaattttgaaatatctacatctatgttcataactttatatcaatatttgtatctatctctttaaatgtctttaagatactatggactgtttaaagcaatataacaatgaactgtgatatcctgtaacatttgtgtaattaaatatatgatgagaacacaaaaatcaggaaggtaataattcaaattatatttttgtaaaattcttattgtttataaagtagtacattattttagaagctagattgttatagattaaagatacataagagaaacgacaaaataaataacacaaagaaacacgactaaaaatgaaaagaagagataaaatggaatactaaaaatatcaattcactctagagatgaaaaacaaataccattttagtagacttaaactcaaacatagtaattattacattaaaagtaaatgtcatttggttcttctagaaagtttactcacacagagtagaagttcaagatattttctcacggtaacacctgtgaataacaaacacgagggtcattaggaatagcaggaaagcatttctattgccaatgtattaatactggtaaaactagaaagagaaggaaaacagattgcataaaaagagctttagattgtaaagtatctttttcatcaacttgtagtaaggatatatgctaacagcgtgacttattgttgatgatattaactttgattacctgaccaaagtagtgttgaacagctttttcaactgtaaaggcattctcctctcttccacactgtagtttttgaaagcaagtcactatttgctacaacccacactcaagagacagtgtcttagtctatttgggctactataacaaaatatcatgaactgagtggcttaaaaataacagaaatttattccttacagttgtggagtcttggaactcttaagttcaaggtattggcagatttaatgtctggttagggtccactttctgtttcatagagggcgccttcttgctgtgttcttagatgatagaatggggtgaggcagctatctcactgcaacctccacctccgggttcaagcgattcttctacctcaacctcctgagtagctgggattacaggcatctgccaccacatctggctagtattttgtatttttagtagagatgtggcttcaccatgttaggcaggtttgtcttgaactcctgacctcacatgatccatccacctcagcctcccaaagtgctgggattacagggtgagtcactgcgcccggcctagcaaaatttcaagtatacaatacagtattgtgttaactctagtctccatgctgtacaccagatcttcagaacttattcatcttataactgaaagtttgtgcacgttcatcaacatgcatccatttcccctaaccgccaggccattgtccattagcaaccagtattctactctcagtttccatgagttggatttttatgaattccacatatcagtgagattgcacagtatttatctttctgtgtctggctttttcacttagcataatccatccagatttattcatgttgttgcaaaagacagtatttcttcttttttatggctgattagtattccattgtgtatatgtactacattttctttatttattcatctgttgatagcattcaagttgttttcataccttggctattataaataatgctgcaatgagcaagagagtgcagatatttctttgagctaatgattttatttacttcgaatatatacccagaaatgatcgttctatttttaattttttgaggattctgcaaactgttctttgtagtagttgtaccaattcacattcccatcagcagtgtactggggttctctttctccacatcctcaccaagagtcgttatttctcatctttttgagagtagctgtactctaggctcatcttgtgtattccctgctcatctttggattaggccatttctccaaggaatcttgatttattttattggagaacagttttagaaacaaagacctggtagttgagtgtgtcagttttactgtagtgttgctacttctaggtcttcaactgatagaactagagaatatatatatgtgtactaactcatgtttacacaaatatatataatcatttacctacttatatatttgtatctgtattacgctagacataagttcacacagctgtccctaactctaatccattaccacgtggttcattctagtttcccctgtccttgcctatctgaaactgctctcccaatagaaataaacctgcctcacagcatccaccatgtatttacatattcgttcgaccctactctacatatacagctttttcagaattgttaacccaggtggctgtgaaaaacaactatagtgtttatgtacagttccttttgtttctagtcttagagtttccaatcaaagcaccgttttccaaaattacttgtcagctagttttctgcccacccttttcagtgaggattttccataaatttgtgatacagctagaatcttttcgtcactatgttcattgcatacaatacagtcttctggttaattcctttaatttgtataaattaaggtttactcattttgttgtacatcttttttttgttgttgttgttgttttgcgatggagtcttgctctgtcatccaggctgaagtgcaatggcgtggtcttggctcactgcaacctccacctcccaggttcaagcaattctcctgcctcagcctgtggagtagctgggattacagcggtctgccatcatgcctggctaatttttgtatttttagtagatatggggtttcaccatgttggccacactggtctcaaactgctgatctcgtgatccgcccgcctcggtccccagagtgctgggattacaggtgtgagccactgcgcccggcctttttgtggtacatctttatgggtttcaacaaacgcatagcattttatatccaccactacactacaatatggattaattccattgaactgaaacatcttagtgcctctcctagtcaaatactctcccttccacaatcatttgaatatcctgatctgtctttcagtccaacagttttcccttctccaaaatgtcatacgaatggacttcaacatagactttcagcctgacttcttatgtatagcaacatccacttaaagttcatctaagtagctccatgagttaatagcttatttatttttattactgagtaatattccattatatggatgtaccactgtttattgatccattaatccaactacaggatattatttcaacattgcttgaaatttttggtgattatgaataaaactgctaaaaacattcatctgcatgtatttcttagacatatattttcaaatcaattgtgtaaatattcaggaacacgcttgctaccttgtatgataaatctaagttatatttagtaagatactgccaaactacattgcaaagtgcctttttgtatccccagcagcgatgaatgagaggtcctgctgctctgagtccttgccaggtttgggaattgtcagtgaagagtctatttagatcttttgccttgttattaattaagtacaagctctttatcagatatattatttgtaaatattttctcccagtttatgacttgtcttttcattcttgcaactgcatccttcacagagcaaaatattttaaaattttatttaaagtttaatttttcattatgttctttcatgagttatactgttaatgctgtactttaaaacacacagtcaagccctaggtaatgtagattgttgtcctatgttttcttctagatgcagaatttctttttcactctttttgctgtaagtttttatgtgttttgaccctatttgtgtaagtatatttttggaatctctattgtgttccagtgatcggtatttctatctttttgttaatagcaaacagttgtaattactgaagcttaataacatgctttaaaatcaggtaataggagtcttgcaaattttttttttgaaaaattgttctgattattttagtagctttacctttccacataaatattgaaccatcttatgaacagaacatctacaaaaagcttgctgagatttttatttatttatttatttttgagatagagtctagctctgtcacccacgctggagtgcagtgatgcgatctcggctcactgcaacctccgcctcccaggttcaagtgattctcctgcctcagcctcctgagtagctgggattacaggcacccaccaccatgcccagctgatttttatatttttagtagagatggggtttcattgtgtcggccagactgatctggaactcctgacctcacgatccgcccacctcagcctctcatcttgctgggatttttattgagattctgttaaattaatagatggaattgggaaaaattaacatctaaacattatggaatgttcaattctttctttttttcattgctgaatataaaaaaaaaatttaaacttaaaaaatactaattatagtagcataaacattgaagcacatagacataaatatagcaaaatatgttaacataagttttaaggaacagaaatcaacagagtatgttctctgaccatgtgggaattaaaatagaaatcaataacagaaagataattttgacaaacaccaaatttgtgaaaattactcaacatactctaaattgccatgagtcaaaaaaaaaaaaaaaaagaaatcagtattaggaaatacttagaaatgaatattagtaacaacatgaattttcaaaatgtgtgagatgaagctaaagtgtatactacaaggtaatttagtaactatgtttacaaatcaaaaatacatggaatttataatatatgtctcaaatttataaagttagaaaaaagaaactaaagataacagtggaagtcattaaaaatgaaaatgaacaaaaagtaaagaatgtcaacaaagtaaaaaggcaatacttgaaaagactagtaaaatttgtaatcctctggaaagagaaaagctacaaattaccaaaataagaaatgaaataatggatgtcatttctcagtactacattactaagaaaatgcaacaaataattcggtgtgaataagtttgacaacgtgaatggagtagaaaaaaattgttttgaattttttgaaagacgtaattggcacaagacatagaaaaatctcaacagtattattaatatttaaaaaaataaaattttaatgatggaatcttcttgcaaagataactctaggactgttttgcttcactagtggattctaggcatttaagaaaatgacaatatactaattatattagaaaacagaagaaaaagaagtatttaaaacttattttattaggcaagtatgtctttgattccaaaaccagacaaggatactcaaacagagaagtattgcagacaaatacctctcatgaataagaggcaaatatttcttttaaaaatatcagcaaattgaatgctacatataaaacatattacaagaaaatatggtttaccgcacctggctcggagggtcctacgcccacggagtctccctgattgctagcacagcagtctgagatcaaactgcaaggcggcagccaggctgggggaggggcgcccgccattgcccaggcttgattaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagggagcagtggttctcccagcacgcagctggagatctgagaacgggcagactgcctcctcaagtggttccctgacacctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacctatctgtacatcaccatcatcaaagaccaaaagtagataaaaccacaaagatggggaaaaaacagaacagaaaaactggaaactctaaaacgcagagtgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctgaggagccgatgtgatcaactggaagaaagggtatcagcaatggaagatgaaatgaatgaaatgaagcgagaagggaagcttagagaaaaaaagtataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagatttaggaaatacagagaacgccacaaagatactcctcgagaagagcaactccaagacacataattgtcagattcaccaaagttgaaatgaaggaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggcctgccctaaaagagctcctgaaggaaacgctaagcatggaaaggaacaaacggtaccagccgctgcaaaatcatgccaaaatgtaaagaccatcaagaacaggaagaaactgcatcaactaacgagcaaaataaccagctaacatcataatgacaggatcatattcacacataacaatattaactttaaatgtaaatggattaaatgctccaattaaaagacacagactggcaaactggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagcctttaaaccaacaaagatcaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgagcacatacttggaagtaaagctctcctcagcaaatgtaaaagaacaggaatgataacaaactatctctcagaccacagtgcaatcaaactagaactcaggattaagaatctcactcacaaccgctcaactacatggaaactgaacaacctgctcctgaatgactactgggtacataacgaaatgaaggcagaaataaagatgttctttgaaaccaacgagaacaaagacacaactcaccagaatatctgggacgcattcaaagcagtgtgtagagggaaatttatagcactaaatgcccacaagagaaagcaggaaagatccaaaattgacaccctaacaccacaattaaaagaactagaaaagcaagagcaaacacattcaaaagctagcagaaggcaagaaataactaaaatcagagcagaactgaaggaaatagagacacaaaaaacccttcaaaaaattaatgaatccaggacctggttttttgaaaggatcaacaaaattgatagaccgctagcaagactaataaagaaaaaaagagagaagaatcaaatagacacaataaaaaatgataaaggggatatcaccaccgattccacggaaattcaaactaccatcagagaatactacaaacacctctatgcaaataaactagaaaatctagaagaaatagataaattccttgacacatacactctcccaagactaaaccaggaagaagttgaatctctgaatagaccaataacaggatctgaaattgtggccgtaaccaatagcttaccaaccaaaaagagtccaggaccagatggattcacagccgaattctaccagaggtacaaggaggaactgctaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctgcttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccccctctcaccactcctgttcaacatagtgttggaagttctggccagggcaattaagcaggagaaggaaataaagggtattcaattaggaaaagaggaagtcaaattgtccctgtttgcagatgacatgattgtatatctagaaaaccccattgtctcagcccaaaatctccttaagctgataagcaactttagaaaagtctcaggatacaaaatcaatgtaccaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagactcaatgtcgtgaaaatggccatactgcccaaggtaatttacagattgaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggcagcaaaacagatatatagatcaatggaacagaacagagccctcagaaataattccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaatctaggcattaccattcaggacataggcatgggcaaagacttcatgtctaaaacaccaaaagcaatggcaacaaaagacaaaattgacaaatgggatctaattaaactaaagagcttctgcacagcaaaagaaactactatcagagtgaacaggcaacctacaaaatgagagaaaattttcgcaacctactcatctgacaaagggctaatatccagaatctacaatgaactcaaacaaatttacaagaaaaaaacaaacaaccccatcagaaagtgggcgaaggacatgaacagacactcctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaattagttcaaccattgtggaagtcagtgtggcgattcctcagggatctagaactagaaataccatttgacccagccatcccactactgggtatatacccaaagaactataaatcatgctgctataaagacacatgcacacgtatgtttattgcggcattattcacaatagcaaagacttggaaccaacccaaatgtccaacaatgatagactggattaagaaaatgtggcgcatagacaccatggaatactatgcagccataaaaaatgatgagttcatgtcctttgtagggacatggatgaaattggaaatcatcattctcagtaaactatcgcaagaacagaaaaccaaacaccgcatattctcactcataggtgcgaattgaacaatgagatcacatggacacaggaaggggaatatcacactctggggactgtggtggggtggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaataaattaattaattaaaaaaaagaaaatatggcttatcccaataacataggatttgtttaagatacaaaaatatacaaaaattatttagtgtaacacattaatagaaaaaagaaaaatattatgtgatcctttcagagtattaaaaaatgactaaatttaatatccactgatgaaaattatctcatcaaactagaaacagaaggacatatctttaatgaatgaagttattaaaaatttctgtagctagtatcatactgaatatgacatagtgcatttcccccctgaagttaaaaacatagcaaatgatttttctctcactttttcatttaacatatgaggagatactggctagtatatataataagtcaaggaaaagaaatagatatagagcttacaaagacaaaaataaactgtctttctcatatgacctcttttgtgtgtagaaaactctaaggaatctaccaaataatacatattaggactaaaaataaatataccagtgttgcagaacatgttaatacgcaaaagttaattctatcttttaatactatcaattaaatgatggaaaataaaattaaggaaatctataaaaatatctactagaggcaattagtgaattccacaaaaattcaggtcactaagtgctatggtctgagtgtttgcattcccctcttattcatatgttgaatcctaatcaacagtgcgatggtttgaggaggtagggcctttgagaattaattagtgcatgatagcagagccctcatgaatggcattagtgccctcatgaaagaacaacttgagagctgccttgtcccttcggccacgtgagaacacgcctagaaggtgtcctctatgaggcagaaaatagccttaaacagactttgactctgctggcaccttgatcatggggttgcccagccacgagaactgtgagaaacaaatctcttttgtttataaggtatcctgtttatggtgttttgttatagcagcactaatgaattaagacactaagttagtatcaaaaaatcacttaatttctatgcattagcaatgaccaattagaaaacaaaatttttaaaagaacaatttacactaacatttaaaaacataaaatactttatggtaaatttaatgaaaaatatttaagacttcttctctgaaagctcattgagtagactctaagagtattttagggatagaagagaagtgaacaaagtcctttttctaaggtaaaaatgacactggtaaagtggagaaaggagcaaatacagtatttttggaattgccaagtagttccttcacctccgtatcatggttcttcaggttccagatgcgaagagtcttaccccatgacacagagactaaaatcaaaccgccactgggtgtaaagctcagatctgctacaacatcttggtggctggaaagattcaaaagcaggagccccgtctgcatctcccatatcttgatctgcctaacattgagtctcatagcaaggaccaggcaagaaacatctggcacttgagggtggttgtgtgcccagagcttcctgctgggtgggaaatgagtaatgaaataaagatatatagcatgtgtatggattaaagcacttcatttatgaatattttaattttccccaaattgatatatagatttaatgcaatctcaatatcctagcaaaaatttacaaataaattaactcactgtttaaaaatttatatagaaaaacaacaaagtaattctgagaaaaagaacagatttagagaacttactctaattcgcttcaagattcattatcaataaaatatataatcatcaggatattgtgatattggtgaaacaaaggaccatgaatggtatggcatagaagaaaaagtttttaaaaattccagataaaagcctcaaatgattttgacccagtagccaaagaagtcaattgggaaacaaaaattatttacaacaaatagtgtttaaacaactatatatatatacacacacacaaacacacatatacacattcatatatatatgaacccttgacttccatatcacatttgaaaattaatagaatatgaataatagacctaacataaaagctaaaagtaaaagacttctgtggacaaaaatagaatatcttcatgacattatttgtggagactcaaaaagtatcactggacattttgctacattaaatcaaatatcactttattttgtaaaatagaaggaggaagagaaaccctgagaggcccttctgtgacaatatattctaaaagatgtaatttctccaaagacatgccaaaatacagttgtaagaaatggtttataaataaatatgaatccatttaataaaagaaaatatgaatactggtttgaaaatgtataattacaatatataaaaatatgcactaagatgcatttttttaaagaacgtagtgatttgtttaattaaaatttgatttctgaagacacatataaaaatttttataaatgaacagaattcatttctaacagaatttgatgaactgttacgtgactaaagtactagtaaagaaaaagaatgttaaattgaggatttattattaacattaagaaaattaggaataaaaaagtatttaaattaaatgagatgcagataattatcaggaaaatagaggatattatttaaataattttatctggatatacaaaattaaaaagaaaataacaatgtttctaaagttgtaacattttcaaatattaagtggagtcaaacacaataaattaaataatcaaaaaggaaatttaaaaaattccagaatctactatgtaaaggctttgacttagtgcactatgaatggcaaagggcataaaatatatcattggtatcaaaaagctcagatcctaactaaaaagataaaagacactggtaaaagaaaggctttgtaaggagcacataaccagtactccatgatttgtgtgcacaagtgctgctggagataagatcgatctttttgaagtatggtatttattagttagaaataaatataaatgataacataaagctatgagttcacagatttattttttctttgtcttccctaagtttaggagtaaagcttactatagtagccatcttgatttgttatcaatcaaaggtagggctgagactgccaaactgtagccctgaaacaaatccagggagcagcatctatgtccaaatacttactctgaatcatggcaatgaactgtgttcttaggatccattccaacaaagtaatccaggaaatcaggtagccagaaaagacaaaatttgtctcactgcacagaaatatttttcttagagaagacaatggaaatataggctttgtttatcatagaaatagctgatatattcttattatgaattaattttattcttttcaatttgcaatagacatggaatacaccttagaatagaagacagaagaacagtatcataatgttaactcttttgttgacaagttgttggaatttctgaaagtcacttaacctccataagacagtttattttcctaaacaaatagaaagtaacaatctcagattgttataactaaaatttagataagataaacaaatgaaagcaagcatatattcagaatacccagtatatctgaaaaaatttcttgacaagaactttatttgggcaattttgtgatattatgcattatcatcttgtttgctctatctgtaaaagaagcaatattgtacttgttcctatttctcctcaaaggtttagtaacatcaaagtggattaataacctgaagtatttatatatatataaaaattcagtgatacatgatataatgctaaaaaagagccagttggtttttatcttggaacttactttctgctgtaaatagagagaaatctatgccttagcagtttctgttcacccataataaatatatatgcaatgctattttattaaaataatcttcattatatattctatctcaataatatctattagtaaaagctattgatatcggtaatatacttgtcattaaaaaattaacaatgctgtatttggcaccatgtaattagggaaggataatattttaatttcttctaattcttactgtaccagattaaaatttttgattttgtggagataacgtcttcaatcaaaaatagtgtttctatttatgataatcttagtccttatgcagatcagttttgtgagctgatatttgctgaagagagatacatttccataaatcatatgaggaatgttgtttaggatcaacactgtaataaggttagctacatcattaggagaattatctttaaatatacacaatttgcttttttttaaaaaaaggtgcagcatgtatctttcatttaatataaaatctcacacaaatatcctaagcaaacctcacaataatggaataaaagcagataataaacttcattttgctatgcaggccagtagtatccacgtatgtaaaatcagagttgaatatttttggcttaaaatacccaatctccgattttcatacaatacactaagccaccataagttaaaacctgaatttgcaagtccaatgactctatgatcctgccagcagtgaacaatgctgattaaggaccatatgtcatttagtgattatttcatgacacaatgatcatttcaaattgctaatgcaacaaaagaaggattttcataaaaatataattttgaatactatttcattttcgagacaaatgcctatttattgtttttttattccctccaaaatcccatggaacaggtcaatatgtaaataagtcattagccaaagggaagggaaataaataaatccctgtactcaaccctaataagatttcagatgagctcctagtaataagcatatgaaaatgatagatacattccctacttcctccagggaatttctatctgacctagttgcaatgctacagagttgagtaggttttctacataaaagtcttgaaaaaatgttaagggaaatttgggaagctttgtgacttctaaaggtattaaaagagaagtgaaataactcaggtttaagtgagtcaaacaaaataaagccttgattttataaaactggaaaaaaagagtaaaacttttgtcagtgattatattaatgtatcatatttcaatataatgtggacatatatatgcatacatttatatatatatgtatgtattggtatttttttctttttcaggactcaaaagcaactggcagattaaaaaaatagctaaaaacagaaaaatatatagctccagagtaccctgaagctaaggccacttgcaatcaaggcccttcataaaatgacagccagcaggtgagcactgtgagacagaggggccaatggagtgcaggctgcttgggccagacaatgcacaagtgattgcaaatgtgtcagaactgtatttcactacaatcacccaacacagcccagggtggtgcgagtttctgttgacaaaattgtatgatgttaagtttctccaatatagaacatattttcaggagaggatgccctggcatctagaatccacgtgcttttatagttaacaaaaaaaaaaaaggaagaaaaagaagaaaataggatttctgtgacccttccctttcaaagaccccatttgaaatatgagaaatgttctgtggaagagaaataagaccatttagaataatgcaggaatttaactagctttgtaggaaaaaagagagcacgtttcactgaaaatttaagtcaaaaatggaaatagcatgcgaggaagacaaaaatgagttgaacaggtccagtttgttgtaaaccaggtctctgagggggagcgagacttaagagtaagctcaattgaaagcagtgagagaaatgtcttaggaaaaaaggacaaacaattagagactaaattcattactcgggatttctacagctacctctcatttctccaccatcattcctgcttgccccaacattcatccttgaagtccggggtattattgcttagcttgcttgagattttgagttcaggatgaaggatgaaagagaatttaggtcaatttatctagtcaatgtattaaagttgcacgccaatgaaaacattgaaagatttgttacaaaattataaaactacattttttgaatcatactacggactagacataggtatgaagctcaacacctaaattattaatttttataaaaatatttgataggctgggcgcagtggctcatgcctgtaatcccagcactttgggaggccaaggcaggcggatcacaaggtcaagagagcgagaccatcctggccaacatggtgaaaccccgtctctattaaaaaaaaaaattagctgggcgtggtggcacatgcttgtagtcccagctactccggaggctgaggcaggagaatcacttgaacccgggaggcagaggttgcagtaagccgagatcgcgccactgcactccagcctagccacagaactagactctgtctcaacaaacaaacaaacaaacaaatatttgataaaatttaatattaaatcataagtatgctataatctggttaaaagtatagataataattatataaaaatgaatattagaacaaattttttcaaacttttaaagagaagaaaatagaaaaagacaggattagaacaatgattcttcacaacatatacactatgagttatagaatgatatcactggagaagaatcaaggcaagttaataataacttttacttactgagcacttagtaagcctatgataattaccagttattatcatatgccaaatactgtgctaagtattttcataatgtattatattctatcaaaataactggtctatgggaacagatttgatatcctgttttccagacaaagcgtagttgcagatactcagtaactagtccatactcacagggtcagtaaatgacaagtatttgaattcatacttccctgactccaacatttattattttgtctactgagctatgtatatttttaatatcataagctatctccagactcagagataatatacaactcttagactgtggctccctgagagcatgttaattaatgagaacctcaacctaagacttaaactaaaccccaaacttatgtctaatcctaaccctacctctggaaatagtaataatctcaattatcttgcttctctatgaaggtgttgtattttgagaggagaggccaggcatttctgttggtgaggctggtgaaatagtgcaggcctgaatatgcagacttcaaacgtttctcatttcgggagtctgattcatgataggcaacaatctcagaattgcaatgtgtcagcacaacatttaatgttctctgaggatgcatgtccaatgtgcatcatggtggggctctgcttcacagccattgagagaccattcagaagagcacatgggtcagagaaatgtacagacagaaagcacaccttcatgtccattcttatcccggaagcggcacgattcacttctagattcattgcctagaattagtttcatggctctctcttcatatggaagcacatgacatatttggtaaattttatttgccactaggggtaacgagaagtacctgaaaggctgtcgaaatcactttctcttcactctgtgccagggtttatgtagacagagaatgtgtttgatgttatgggcttttcttgcaaagttttttagtctgttttgtattaaagtaagttctctcaagaaagagttgcttaattagcaacattaaaatttatttttatgtatttaagaaccataattttctcatagttttcagttagattatatgttaaaattgtttattttcattggcatgaattttgtagattcagttttttattctgataatataaatatgacatttaatttttttgttaatggaaatattgtgctataatactttaaatatatattatgtagagtcatatattaaaataatttcaataatctaatttatatttttaattctattgattttatagcattcattgttatctcattcttttttaatttttaacttttgtgggtacatagtaggtacatatatttgtggagtacatgagatatttggatacaggcatgtaatgtggaaatcattactcaggatttctatagctacctctcatttcacatcagggtaaatggggtatctgccacctcaagcatctccatgagtaaaattgttttaatttttagatcccacaaataagtgagaacatgtgaaatttgtctttctgtgcgtggtttatttcacttgacatgatgacctccagttccatccatgttgttgcaaatgacagggtctcatttttttatggctgaaaagtactccattctgtatatgtaccacattttctttatccgttcatctgctaatgaacatctaggttgctttcaaaccttggctattgtgaatagtgctgcaatgaatgtgggagtgcagatatctctttgatatactgatttcatttcttttgggtatatatctagcagtgagattgctggattatatggcagttctaattttgtttttttgaggaacttccaagatgttctacatagtgattgtactaatttacattccctccaacagtgtaccagggttcccttttctccacctccccgccagcatttgttattgcttttctttttgataaaggtcattttaatggagtgagataatatcccattgttttgatttgcatttctctgatgatcagtgatgctgagcaccttttcatatatctgtcatttgtatgtcttcttttgaaaaatgtctactcagacttttgcccattttaaaattggattattagattttttctatagagctgtttgagctctttatatattctagttattaatcttttgacagatgggtagtttacaaatattttctgtcattctgtaggttgtctcttcacttcgttgattgtttcctttgctgtgtagaagctttttaacttgatgtcatcccatttgttcccttttactttggttgtctgtgctggtgaagtattactcaagaaattccagccccattcaatgttctggagagattacccgatgttttcttttaatagtttcatagggtgaggtgtgaggtcctagatgtaagtatttaacccattttgatttggtttttgtacaaggtgagataggagtcaacttttattctgctataatatccagttatcccagcacaatttattgaagagactatcctttccccaatatatgttcttggtgtctttgttgagaatgagtatcctatagatggatggatttatttcaggtttctctaatctgttccattcatctatgtgtttgtttttatgctagtaccatgctgttttgatcactatagctctgcagtgtaatttgaagttagataatgtgatttctccagttttactctttttgttcaggatagctttggctattctgctttttgtggttccgtatacattttaagaatttttttttctgtttctgtgaagaataccatagataccttgatagacattgcattaaaactataggttgccttgggtaatatggtcattttaacaatatttattcttgcaatccatgaacagggaatatttttcaatttttgtgtcctcttcaatttcatgcataggttttgtagtttttattgtagatatctttaacttctttagttaatttctaagtattttatttgcagctattgtaaatgggattcctttcttgatttatttttcagattgtttgctgttggtacatagaaatgctattgattttgtggattgatgttctatcctgcaaatttactgaatttgttaatcaatttcaatagtgttttggtggggtatttagttttgtacaaacagaaggtcatagcatcagtaaaaaaggatgatttgactttttcctttccaatttgaatggactttatttatttcatctttctgattactccagctaggactttcagtactacattgaataacagtggtgaaagatggctttcttgttgtattttagatcgtaaaggaaaagctttcagtttttttcccattcagtacaatactagctgtgggtctcttgtagatgacttttcttatgatgaggtatgtttttttaaacccagtttatggggtttagatagtaaatggctgttgaattttatcagatgctttgtcagcagcaattgaaatgattgtacagtttttgtgcttcattctgttgatataatgtgtatcacattgattgatttgcatatgtcaaatctttcttgaataccagggataaattccacttaaacacaattaatgatctttttattctgttgttgacttggtttttttagtattttcttgaggatttttgcatcaatattcatcaggaatattggcctttagtttcctatctctgatgtatctttgtttgcttttgttattaggctaaaacttgcctcatagagtaagatatgaagtgattcctcctctatgttttggaatagtttgagtaggactgctattagttcttctttaaatgtttggtagaattcagctgtgaagccatcatgtcttgagctttttgttgctggaataatttttattgcagcttctttctcattacttgttattggtctgttcaagtgttggctttcttcatagtttaatcttggtaggttgtgtgtgtctaagaatttatgtatttattctagatgttccaatttattggcatatagttgctcatagtagacactaacgatcctttaaaattctgtggtatggattatagtgtatacttattcaaatctgatttatttatttgtgtcttttctccttttctcatagtctgactaaagatatgttcattgtatttatctctaaaaataacccacctttttgtttcattgatcttttgtattgttttcataatttcaaatttacttatttctgctctgatcttttttttttatttcaataggtttttggggaacaagtggtgtttggttacatggatacattctttagtggtgatttctaaaattccagtgcatccatcacccaagcagtgtacactgtacccaatgtatagtcttttatccctcactcccctcccacccttccctctgagtcctcaaagtccattgtatcattcttatgcctttgcatcccatagcttagctcccacttataagtgagaacatacaatgttcagttttccattctggagttacttaatttagaataatggtctccagctccacccagtttcctgtaaatgccattacttcattcctttttatgggtgaatagcattccatggtgtgtatgtgtatatatacatatatatatatatatcacattttctttatccgtacattggttgatgggcatttgggccagtttcatatatttgccattgcaaattatgctgctataaacatgtgtgcaaatgtctttttcatatgatgacttattttcctctgggtagatactcagtagtggaatttcaggatcaaatggtagatctacttttagttccttaaggaatctccacaatgttttccataatggttgtactactttacattcccaccaacggtgtaaaagtgttcccttttcaccacatccacaccaacatctattattttatgatttttttattatggccattcttgtggaagtaaggtggtatcacattgtggttttgatttgcatttccctgatcattagtgatgctgagcatttttaatgtgtttgttggtcatttatatatcttcttttgagaattgcctattcatgtccttagtccactttttgatgggattatttgtttttttcttgctgatttgtttgagttccttattgattctggatattagtcctttgttgaatgcatagtttgtgaagattttctcccactttgtgggttgtctgtttactctgctaattatttattttgtggggcagaagctttttagtttaattaagtcccatctatttatctttatttttgttgcatttgcttttgggttcttggtcatgaaatctctgcctaagccaatgtctagaggaatttttctgatgttatcttccagaatttttgtggtatcaggtcctagatttaagtttttgatccatattgagttgatttcagtataaggagagaggtgaggatccagttttattcttctccatgtggctagccaattatccctgtaccatttgttgaatagggtgtccgtttgtgtttttgtttgctttgttgaagatcacttgcctgtaagtatttgggtttatttctgggttctctagtctgttccattggtctatgtgcctatttttataccagtaccatgctattttggtgtctatagctttatagtatagtttgaagtcaggtaatgtgatgccttgaaatttgtcctttttgcttagtcttgcgttggctatgcaggctcttttttggttctatatgaattttaggattgttttttctagttctgtgaagaatgatgatggcaatttggagaaaattgagttaaatttgtagattgcttttggcatttttacaatattgattctactcatccatgagcatgaaatgtgtttccatttgcttgtgtcatctatgatttacttcagcagtgttttgtagttttccttgtaaaagtcattcacattttgaggatattcctgttaaggatattcccaagtattttatttttttacttattttatttcatttttgccactattgtaaaagtggtcaggttcttgatttgattcttagcttgctcactgttggtgtgtagcagtgctactgatctgtgtagattgattttgtgtcctaaaactttactgaattcatctacgagatctaggagcttttttgatgagtatttggagttttctaggcatacactcatatcatgggtaaacagcaacagtttgtcttgttattgactgatttgaacgacctttctttttttctcgtcttattggtctggttattgcttccagtactatgttgaaaagaagtggtgacgttgggcatccttgtcttgtttcagttctcagtgggaattctttcaaattttccccttcagtataatgttggctgtgggtttttcacagatagctattattaccttaaactataccccttctaggtagattttattgatggttttaaccataaagtgatgctggattttgtcaaatgctttttctgcatttattgagataattatgtgatttttattttaaattctgtttatgtggtgtatcacatttattgacttgcatatgttaaactatccttgcattcatagcatgaaacccacttgatcgtggtggcttatcttttgtatatgttgtcggactcagttagctaggattttgttgaggatttttgcatctgtattcatcagggatattggtctgtagtttcctttttttgttatgtcctttcctggttttggtgttagggtggtactggcttcataaaataatttggttaaaattccctctttctctatcttatggaatcttatctaatactttcaacaagattggtaccaattcttctttgaatgtctaatataattcagctgtgaatccatctggtcttggacattttttggttggaaattattttattaccacttcaaactcactgcttgttattggtctattcagagtttctatttcttactgatttaatctaggagggttgtgtattttcaggaatttatccatctcctctaggttttttagtttgtgcatataaaggggttcatagtatccttgaatgatcttttgtatttctgtggtattggttgtaatatcttttatttcatttctaattgagcttatttgaatcttctgtcttcttttcttggttaacctcactaatggcttaccaattttatctatctttttaaagaatcagcattttgcttcgtttatcttttgtattttttgtttgcatttcatttagtccttctctgatcattgttatttcctttcttctgttgggtttgttcctgtttctctagttccttgagatgtgaccttaattgtctatttgtgctgtttcagactttttgacataagcgattaatgctatgaacttttctcttagcactgcttttgctgtatcccagagtttttgataggttatattactattgtcattcagttcaaagatttttttaaatttccatcttgatttcattatcgaccaacaatctttcaggagtggattatttaattttatatatttacataattttgaggattccatttggaattgatttacaatattattgcactgctgtctgagagaatactcaagataattttgattttcttaaacttattgagacttgttttgtggcctatcatatgatctatcttggagaatgttccatgtgctgatgaatataatgtatgttctgcagttgttaagtagaatgttctgtaaatgtctgttaacatccattcttttctagggtatcgtttaagtccattgtttctttgttgactttctgtcctgatgattgtctagtgctgtcaatggggtattgaattcccccactattattgtgttgctatctatctcatttcttatatctaatattaattgttttataaatttgggagctccagtgttacaatatatatttaggattgtgatgttttcctgttggactagtccttttatcattcactatataatgtccctctttgtcttttttaactgttgttgccttaaagtttgttttatctgatataagaatagctactcctactcattttcggtgtccatttgcatggaatatctttttctgccttttaaccttcagtttatgtgggtccttatgtgttaagtgagtctcttgaagacagcagatacttggttggtgaattcttatccaatctgccactctgtatcttgtaagtagagcatttagctcatttacattcaatgttagtattgagatgtgaggtactattgtattcatcctgctagctgttgtgggaagacttcgttattttcttcatcgtgttattgttttataggccctgtgagatttatgctttaaggaggttctattctggtgtatttagaggttttgtttcaagatttagaactccttttagaagttcttgtagtgctggcttggtagtggagaattctctcagcatttgtttgtctgaaaaggactttatctctccatgtatgaagtgtagttttgctagatacaaaatttttggctgataattgtcttgtttaaggaatctagatacagaattctcagctgataattgttttgtttaagggggctaaagacaggacccagttacttctagcttgcagggtttctgctgagaatactgctgttaatctgatagattttcctttataggttacctgactcttttgcttcacatctcttaagattcttcatgttgactttagataacctgatgactatgtgcctaggcagtgttctttttgcaatgaatttcccaggtgttctttgtgcttcttgtatttggatgtctaggtctctagcaaggccagggaagttttccttgattattttctcaaataagttttccaaacttttagatttctcttttacttcaggaacacaaattattcttaggtttggtcatttaatataatcacaactattggaggctttactcattttttaaattctttttttctttgtcttcattggattgggttgattctaaagccttgttttcaagctctgaagttctttcttttatttgtttgattctattgttgaaactttccagtgtattttgcatgtctcttagtgtgtctttcatttccagaagttgtgattatttttaatttatggtatctatttctctggagatttttttcatctatatcctgtattatttttaaaattcctttaacttggttttcacctttctctggtgcctccttaagtagctcaataatcaaccttctgaattcttttttttctggcaaatcagagatttcttttcagtttggatctattgctggttatctagtgtgatcttttaggggtgttaaagaatcttgctttgttatattaccagaattgtttttctggtttcttctcatttgagcacactatgtcagaggaaagatctaggattcaggggctgctgtccagattcttttgtcccaaagggtgatcccttgatgtggtgctctcctccttcccctagagatggggcttcctgagagctagactgcagtgatttttattgcttttctgagtctagccaccccgtggagccatcaggccctgggctggtactggggagtgtctacaaagtgtcctgtgatgtgatttgtcttcaggtctctcagctgtggatacagcctccttctgcagtggaggtagcaggggagtgatttggactctgtgaaggtccttggttttagctttgtttagtatgctggttttctcaaacgctagttgtgcaggcagtgaagttgtcacatggacagactcaagacctccggttagtcaggatattacaggtggtagaattagctgttgttttctcctttcttggagcagggtcattcttttatgaattgctgtaatggcttgagttggttagcctccagccaggaggtggtgctttcaagacagcatcagctgcagtagtatagcgcggatacaagcttgccatagggtcacttggataggcattttggtttctcaggctatgggaagagccatagaactcccaagagattatgtcttttgtcattggctaccagggtgggtagagaaagtccactaggagcagggttagatgtgtctgagctcagactcttcatgggtgcggcttcttgcagctgctgtgagagatggaggtgtggttctcaggccaatggggttatgttcccagggggattatgtccacctctgctgcatcatacaggtcaccagggaagtgggggtaacaccagcaatgacaggtcttacccagctcccatgccaccagcaaggtcagtctcactccctccatgcttcatcaacagcactgagtttatatccaggtatctggctgagatcttgctccagtctacatgccttctcactgagaaagcaagcagggctttcaggactcaccccttccaccctgccatggcttctgtgctcttttctgtacttcctattcacccccctgctacctaaccccagattctgcccaggaaaatttactcttgggcaaaattattacaaagttcagctgaaagtttccttctccctttcatccttccccaagtccaccggcagccctcccctagtacccctgtgagataaagtaaaaaatggcttcccagtggggactgggagtgcctatcgggctcttcctgctgttcttctactttcatactttggttagctctctaaattcatttcagctctgggtaaggttaaatccttctcccatgatttggattttcaggttccccagtgaggatgtgtgttcagaggggaagtttccccctctcacactttgggcattcagttttttggctgtctaacaaagtttgcagcagcaaagctgtttatttcaaactgaaaattatttcagttttcctggtatgttgctatggtagttctaggagtaaatgttcacaatgtgagcctccacacactgttctggggctgaaagaacaaaagaaaaactttcattgccattgtaaaggaaggaccacaggtggaggtcagcaacagagggtttctgctctgatatttattattttttttcttctacgaattttggctttagtttgttcttgcttctccagttctttaagatgcattgttaggttatttatttgaagtttttctactttttaatgtaggcacttatagctataaattttcctctcagtactacttttgctgtttcccataggttttggtatattgtgtttccattgtcatttcaagacaattttaaattaccatcttaattgacccactattacttcagcagcatattgaggtatgtttgcagagcttccaaaatgcccttgttattgatttgtagttttattgcattgtgatcagaaaagacgcttgatattttttctgttttttgaatgttttaagacttgttttgtgcactatatgtacaaaataatatatggtctatccttgagaaagatcaatgtgctaaggagaagaatgtgtactctgtatccattggataaaatgttctgtaaatatctcttaggtctatttcgtctatagtgccaataaaatctgatggttccttgttatctgtctagaagattgggtcaatcctgaaagtgggttgctatgtctccagctattattatattgggatctatctctctctttagttctaataaaatttactttttatatctgggtgctccagtgttgggtgcgtgtaaatttgcaatagttacatcctcttgtttaactgatcactttatcattagatagtgaccttgtttatctcttcgtatagtttttgccttgaaatccttttttattatataagtataagctacttctgctcttctttggctcccttgtcatggaatatctttttctgttttatttatttatttatttattttttagtttcagttatatgtgtctttataggtgaattgtgttacttgtaggcagcagatcattggggtctcattttttcatccactcagccactctatgtctttgattgcagagtttagtccattttaattccatgatattattggtaagtaaggacttgctgttgccattttatcatttgttttctggttgttttgtggtcttctctttcttcttttcttccttcatgtcttccttttagtgaaggtgattttctctgctggtatgacttaatttcttgcttttttctctgtatgtatccattgtgttttttttatttgaagttaccatgaggcttgcaatactatattataacttattattttaagctaataacaacttaacgctgcttgtctaagcaaacaaacaggcaaaataaaaactcataaaaactctacactataactttgtctccccactctttaactttttattgtttctatttttatcttattgtactgtatatgtcttgaaaagttgctgtagttattatttttgattggttcatcttttaacctttctacttaaaagtaatttacacacaacaattagagtattataatattttgtgggtttttgtgtacttactaatgctagtgagttttgtaccttcagatggtatattattgatcgttaacatcctttttctttatgattgcagaaatctctttagcatttcttttggggcaggtctgctgttgatgaaatgcctcagcttttgtttgtttgtgaaaatctttatttctttatcatgtttgaaggatattttcagtgggtatactcttttatggtaaaaggtaacagtgtgttttgtttttccttcagcacttaaaatatgtcatgctactctcttctgccctataaggtttccactgagaagtctgctgccagacatgttggagctccattgtatgttatctgtttctttctcttccttttacaatttttttctttatcattgacctttgggagattaattattaaatgccttgaggtagtcccctttgagttaaatctgcttattattctataactttcttgtacttgaatgatgacttcttcctctaagtttgggatattctctgttattatccctttgaatgaactttctacttctatttctctctgtaactcttatttaaggccagtaacttagatttgcccttttaaggctatttgctaaatcctgtaagtatgcttcattgtttttattcttttttcttttgtctcttctgagtgtgtattttcaaatagtctgtcttcaagctctctaattcttccttcttcttgatcaattctgctattaagagactcatatattctttagtatgtcacttgcatttttgaactccagaatttctgcttgatctttttaattattttattcactttttaaaatttatctaataggattctgaattccctctctgtgttatcttgaatttctttgagttttctcaaaacacctattgtgatttcttgttctgaaaggtcatatatagctgcttctctgggactggtctttgatgccttatttatttcatttggtaaggttatgttttcctggagcaacctgatgctcatggctgttcactggtatctgagcattgaagagttaggtatttattgtagtcttcacaatctgggctggatgtacttgctcttcttgggaaggcttttcaggtatttgaagggatgtgggcattctgatctaagccatatctgcattagggggcacactaagttcagtaccactgtggttcttgcatattcatagatgtactgccttggtgatgttggataatatccagaagaattccttgattaccagacagagacttttgttctcttcccttaccttctcccaaataaatggagtatatatctctgtgtgtgctgagctgcctggggctgggtgtggggtgacttaagtaaacctgtgaccaccactatgtggactgtgctgagtcagacctgatgtcagcacagcactgggtctcacccaaggcccactgtaactactacttggctattgcttatgtttgctcaaggccatagggctctacaattaacaggtggtgaattcaatcacgcttgtgtctttcccttcaggttggcaagttctctcaggccccaggtggatccaggtatgctgtccaagaaccagggactggagtcacaaaccttaaaactctaccagacgctctctctattctactgctgctaacctggccatcacaccatgagaaaaatatccttcccactcttctctcccttttccacaggcagaggagcctctcctgtggctagccccatcacaggcctacatagagtacttccaggtgacctcttgtgttcacttaaggtccaagggtgcttctgtagtttgtggttaatgctgccaggcctgagactcactttttgggtagcaagctcccttttggcctagtgggtccagaattgccatccaagaaccagtgcttggaattggggaccctaagagcccacttggtgctctacccaactgtggttgagctagtatccgaagccatcacaatctagagtctcatataaggcccatgatgaatgctacctgggtattgctgctggttattcagggcccaggtgctctttagtgagtggcaaatgaaatcttccaatattttgttcttcctttataggaagtgggttcttttctggcccaggtgtgtctagaaaagttgtccagaagctagggcctagaatgagaccctcacaactctgtccagtgccctatcctgctgtggctgagctggtatccaagatgcaagacaaatcctctttattcttccctctcctttcctcaaatggaaggaaggggtcacttttagggctacaagctgtgcttcctggggttggggaatgggtggcacaagcactcccttattcaccccagctcatgtttcactaagtcacatgtcccttatgtacactggacttgaggccaacacagcactctgatttgcctaagaattgtagtcattgtggcctagactgcccttcaagtttatttaggaacccagaggcctttaacccccactgatccggcttgccagaactcaagatctgatcactgggatgagcaatttccatctggctagggctggtctaattgctccctctatggtcttgcatcagctgagttctgcccagtttttctttacactatgacaggtcagcattgagttcaatgcaaagttcaacaattgctgtgctgtccctcacccaaacacacaaattctctatctgcaccacctgctgctactaggtgatgggggaaagggtggtgttggcaattcaagactgtcttcctaccttttcaatgcctcgttttaggaaatataaagttagaaacagatactaagggctcacctgagcttgggttcttataaaggtgtttttttttgtgtgtgtgtagatagttgttaaaatgggtgtttctgcagatggaatggtcagtggaggcttatgttcaaccatcttgctcctctgctccagccccattgttttaatgcacatgtatttgtttatttctgatagtaaacatgtaaatctttataattattattaataaaattgagttttaaaacttttttagtgagattaaacatttcaaatatgtcgtatatgtttgcttgtttaagcaccttacactataagtcattgtaataaggcatacatttacaagcaaatgtatttctgctccatagaaattaatgaaaactacagggaacttgaatatagaaattggaaatgattttataaaatatatttttaaggaggctccattctggaatgtttgttttcctatgaggattctcttatgagcagctatttgtttacagcataaactgttttaaaattattttaggtcatgttcgattatatgaaaacaagtatcctaatatacatgtttataaatataaagtgaattagtatttgaagttgttttattaattttttaaagaattcctttcttttgtacgatgtgcatgacttgttatttctggattctttcttttagtttccttacattagattttcatttaaaatatcattttaattctcaaaatttctatttagtctccactatatatcttaattgcatgagaatgcatatccctagagaattggatagtgtactttatttctaaggtcagtgatctgattatcttctcattctctccattttagccacgctattttctttccattttggtcaaaataaggcagtgcaatttcactttcaaattaattaattctctcatctctaacaattataggtattgcttttttcctgcagtttctatttatcacttttcttttttcaccacagcatccagtaaaattaaatatataaacaaccttaaatttataagtatgtatttattttaaggtggaaactaatatcagctgttctcaagttttatcagtagtggttctacaagttaatttcttaaaaaaaatcaaacatttatgggggtatccatgagtgaaagaaccttgtggatgtgaagaatcgacaaaaagcaacgatttgttcctataatgttcacatatataaatagaaatttagaacatatcaataataagaatgaagaagagggacacttttatgcagctttcccatttaatatttctacatttatttatactgtgggtttgtgacactagaaagtattgtttgtggagaagaaaacacaaaaagagagagcatcataatgaagataaccaggtgttttgcagacaatcttaaactcataccaacagcagatatttagctcagtatgcctaggaagaaaatatttcactttctccttcaccttgccctactgcccatgagtctagttccagttttctttttttctgaaacagggtctcactctgttgcaggttagagtgcagtggctcgatcttgacttactgcagtcctcacctcctgagctcaagcaatcctcctgcgtcagcctcctgtgtagctggaactacaggtgtgtgctgccacacctggccatgttttacatttttttgtagagacagggatctcactttgttgcctaggctggtctcaaactacctggctcaagtgatcctccagtcttcacctcccaaatttcagggattacaggtatgaaccactgtacctggctaggtctagttttttaaaggaaaaaaaaagttgcctaggaaaataatgtagagtatttcaggtactgggaaactgacatcagaatcaaagagagaatgtgcttattattttccaactctggaaaattagtctgtggtgggaaattcaatgggagatgattagaaacgaagctgtgagaatagctgactgtcccaattaacaacgtaaaactgcaagagaaactacataagtcttcacaggaacaagtgcttaaaaacctaagtttatatcaaagactaatgaataacctggctgggctgaaactgtctctttaaaagtgagaagaaatgcagatacaagtaagactgggatcaaagcctgagtgaccatagagagatgataaatagttttccaatcatcccatcataaatactgcttttcaatgagactaatattaggggaatagatgatttatgggtattccaaagaaattgtgactatacaaagcgtcttagaaaaataaaaatacagaggagtaagagtctgaaaagaagtaaatagatttattcacactgatagttctgatgaggtttctgaaatggattttctcacagttctaattataaaactagcaatattcttaaaatcctcacatacaagtacaacttttaaatttacctgtttaaggaaattcagtactttcagtgtagatatgaaacacagtagcattggcttgtttatttccaaaatccatgttattagtctacagactatagcaaacatattttaggggaagtatgcatttaacacttattcaataaccaaaatgctcattacattgaacagcacataattaaaaatagcaagatgcttcaatagccttaaaaatgaacagaataagttgagtataacgacaataaggaggcaaagtatcaaaacaaacaaacaaaaactagatgcattaaaacatacttccaaaattatttttatattccgggtcattatgatatttatttatcattaacaagggggccttttaaaaggaaaagtttggaacactccatgcacagacaagctgagatggaaggcagggtggtagagtagaaaggcttaaccaaacttgactttcactatgactttgacaatgtcatttaatctgatatttgtttcttcatctttaatagcttcttgggattgttgtgaggattaaatgtgtattttaatgttttgataatattaaatgcacacgaagtccttccttcgtttgaaataaagacacaaatattgtatgcaaaagcaagtcaatgatcactttcatttgtgtttcagagggcaaagctatgttattttttcatttaaaatatatattgtagtcactacaacatttactaaatgactatatttatataaaggatatgtaaagatgaatctgtatattatatgtttaatgtaaaactatgtgtctagcatacagaaacagaaatttcatgtcagaaatattaaaaaaaattaattcttgtgaacttgttaaaaagccccctaatatcatctttctgtgatgaacccaaaagtctcttgcaaaggttaagtttttaataatagctgcttttatgaaggagattatgatataactaagattactgatttaatataaaaggacacagaatagcagatgagagggaaatgtggcacaagtctgcaatgggtttcccatggataacagaattcactattttataacgagtctgctctccttgataacagagccacaaccattcagggtgtttagaaatttattggaggcatttctttgattattgctaaaatattaggggatgttgctgcattagtagatgaagaccaagaatattagacattttataaaccatggagctgtcctgcaaaacaaacaaaattctccaatgctgcacaaattttgaattttcctcattgccatttaaaatcatctgagcctagaatctaactccattatacatataaccaaaatatttttagtggttgtaatatacattgaattttcctggaattcatctataaatcaagggaacgttttctactgttttgctcaacttttaccaaaagttgttgcctattttggaaaatgatattacaatgtcaaagttgcgaatgatatttgagttatcaatgtaacatacctgtgtatgtttgcatttataatatatttatgaaaattttaaatataaatttaaaaatattttaaaatgtcaaatacaaagaaaaggtatcaattatatttagctggttatttaacatagttttatagcttatctaataattgaaccatttatcatatgactagtctgccaacacttttaattttgagacaggatctcactctgtctccccagctggaatccagtggcatgatcatggctcagtgcagcctccacttcctggactcaagccatctgccacctcagcctcctgagtagctgcactacagttgcacaccaccacactcagatttttttttcattttttgtggagaggaggtttcaccacgctgatcttgaacttctggcctcaaccgatcctcccacctcagcctcccacagtgctaagattataagcatgagccaccacagagcaacagatttttaaatgcaacaataaaactacaagattgaatgtaaatttttctaaggagcacactgattaaattagcaaggatatagtatcatgtttctgaaatttatgagaaaagtttgaaaactgtattactgtcaccaaactgttttaaatacgtcctaattggagaaataaaggtctcattatttcttacaggatagcacaatgcattataagatacataaggccaaaatattaaagaatattaatatttccagctgtatgaaacattgttattttatgttagaaagaaatccaaataaaaaaatttgtatttcactaagcaatgatattgtattaagaaggcttgaggaaattgtgaaaaatgtcaaagatcattgacacttctatgaaaatgtgcaatgaactgcagctaagcacattttcatacaacagatgaaagtatcctatatgaaaatgattcaatgctgcttataaataagtttcataaagattaaataacatgaaaaaatgttactttcaaaagtactgagaatagatacaaagagattgtcaatttgcaaatcccttaaaaaatatctcatagaaaaacatattcactttcaaagaccactacctggctatcagcaatgatgggtcaacaaagtggatttagagtcaacttcaatagctctaggtactttagtaattcactgcattattaagtgacaatatgaaagcattaaggatgttaaagggatgcttcaaaatcaatgaatgttgcattcagtgtatttgtccattctcaggccattacaaagaaacacctgagcctgggtaatttacaaaggaaagaggtttaattgactcccagttctgcagggctgggaagtcagtcttcaggaaactcacaatcatggtggacgagaaagcaaacatgcccttcttcacatggtggcagcaagaagtatgcagtaaagggagggaaaagccccttataaaaccaccagatctcatgataactcactcactgtcatgagaacagcccccatgtttcaattacctcccactgggtccctcccatgatacatggggattaatgggaactattatatgattcaagataagatttgggtggggacacagcaaaaccatattattctgccctagcctcctcccaaatctcatgtcctcacatttcaaaacacaataatgccgctccaacagtctcccaaagtcttaactcattccagcactaactcaaaagtccaagtccaaagtctcacccgagacaagcaagtcccttctgcctataagcctgtaaagtcacaagcaggttacttacttcctagatacaatggggttacaggcattgggtaaatacagccattccaaataggagaaattggccaaaacaaacgggctataagccccatgaagttcaaaatccaatagggcagtcattaaaccttaagtttccaaaatgatctcctttgactccatgtctcacatccagggcatgctgatgcaagatgtgggtttctgcggccttgggaagttctgcccctgtggatttgcagggcacaggcccctctgtctgcttgcacaggctgatattgaatgtctgcagcttttccagttgcatggtgcaagctgtcagtggttctaccattctggggtctggaggatggtggccctcttctcacagctccactaggcagtgccccagtggggactctgtgtgggggctccaaccccacatttcccttctgcactgccctagcagaggttctccatgaggggtccatcctgcagcaaacttctgcctggacaccaaggtgtttccacacatcttctgaaatctaggtggaggttcccaaagctcaattcttaacttctgtgcacctgcaggctcaataccacctggaagctgccaaggctttggacttgccccctctgaagccatggcctgaactgtatcttggttcctcttagccatggatggagcagctgagatgcagggcaccaggtcccaaggctgcacacagcaaagggtgtggggggctctgggactggcccattaaaccacttttttctcctagacctccaggtctgtgacgggaggggctgccacgaaggtctctgacatgccctggagacattttcccattatcttggttgtaaacattcagcttcatgttgcttatgcaaatttctgcagtaggcttgtctttctccccagaaaatgggtttttcttttctattgcatcatcgggctgcaaattttccaaatttttatgctctgcttcctcttgaatgttttgccacgtataaactttttctgctagataccctaaatcatctctctcaaattcaaagttccacagatctctaggacaggggcaaaatgctgccagtctctttgataaagcatagcaaaaatcacctatgctttagttcccaacaagttcctcaactccatctgagaccacctcagcctggacttcattgtccatatcactatcaatattttggccaaagtcattcaacaagtctctaggaagttccaaatttccccacatcttcctacctccgcccccatgatccaattacttcccactgggtcccttcccagaacacatggggattatgggaactacaattcaagataaaatttgggtggggacacagccaaagcatatcacagtgttaccaacaaaataaaaaataaactatgcaatggtaattgcattcatttgaaattggaattcagatgagtttttaatgtatatttaatttttaattatataaaattattaaaaaatttttgattcattaaatgaaaaattaagcatcataattcaaatatcacaaaatgatatgatacatctttcagatatctttatatatttgtatagttaaatgatatcctttataagctgctagaaaataagatcaatcttatagtaaccagaattgtcatgagatatttaagcaaacatatattatttaaaagtagcctgagcatcaaacatttttacagcttttatttttgcagaagttagataaatccaagtagattgctttttttgaatggctgctaaaatgagaacatgattagtttttttaaattttagtttaatttacaaaactggactgagtaattaatttatttgaaatagaggaagaacattgttagccaaaaattttctgaaaaatttaattgagctgaaaatcaatgttttcagggaccaaagtacactttaatcaatctaattatgcaaggtgtttgatgtcttatatacatttctttggaaagaagaaagttaaattgctctggaatttccaagaacatgtttggtgaaaggctgtcagggttacaatttaattctggcaaaagcaagattactgatgggtctgtgtagcagaggaaacatgagattccttttaatacactttaagcaacttcaatagaacacataaaattcagaattctcactgaatttaatgaataaagattgttttaaaatcttatatatatatgtatatgcacacccatatgtatgcaatttaattttttgtaacatgcataaatctaggttgcagaaatcacatattgaaataatatgtctcagttataaaaatcacatattttgtttcaacacataattgtttcaacaaattagagagataatttatcattaatcaattttatcctgctatatgctcagaggtctagcgctcactttgacaagagcaacactgtgctatggagatacaaatgtaagtcacatttatcatttgaaatgttttagtggccacattacaaaaagcggaaaaaaacagaaaaaaataattttaattatatactatatttaacacagtgcatctcctaactgtaattcaaacctataattaatcagtgtaaacattattgagatattgtacattttcttagtttttaatataaatctaactttactaaaataaataacattaaaaattcaattttcagtaccactgaccacattttaaatgctccataatcacaccaggctaggggttatcatattagacaacactgggctgtactgttatttattactgttattagctatcttactgacaactattaattagcttaatacagtttttatgttagtatctggacacatgtctctttttttattttcctgcactagttatattaagctccttctcttacgttcaaacttaccttgagaaggtgcaggaatgtaatgacttcataaggtcttttataatagctaattatttgcaataaatcttgtttcttttctttcggttatgagctatactgatacttttgaatcaatataatataagatttttgcatcaataatgtgtgattttgaattattctaatgacttgttttagattatattttattttctttctttctctctttctttcttttttttttttttttttttgagacagagtctcactctgtcgcccaggctggagtgctgtggcgcgatttcggctcactgcaagctccacctcctgtgttcacaccattctcctgcctcagcctcctgagtagttgggactacaggtgcctgccaccacaaccagctaattttttgtatttttagtagagatggggtttcactgtgttagccaggatggtctcgatctcctgacctcgtgatctgcccgccttggcctcccaaagtgctgggattacaagagtgagccaccgtgcctggctcttagattatatttcctataaatgtgattttaagctgtgcaatagactgtgttccccccaaaatttgcatgataaaacctcatcccaatgtgatggcttttgagaggtaattaggtcataagagtggggcccttaggaatggaactggtgccctcataagaagagaccagaaagctggctaggtctcttcccaccctcttcccaccgtcgaaagatgtaataggtacacagtttgcaagccagaagaggttgctcaccagaacctaactatgctggctccctgatcttagacttccagcctccggaactgtgagaaatgaatttctgttgtgtataacgcatccagtctatggtattttgttacagcagcctgaactgataaggaggtacagtgtaggaaattttagaaaatattagagaatgtaagaccactgatctacatgaacacagtaatagttttctactttctgcagcaggaagaacaagccgtgttctctgattgatttctagacttgttaaactgctacaccagcttaactctgagcacagcaaaacttcagtggctatcatactgacattctttttacaatgattccatctctcccaacttttgtcataattcctgtctatctcatattttcactaagcacgttagactgtgtcttcaaattaagtgttctaaaatttgaagtgagaacagaaaaagcataagaaaatggatcaataatattgacaataaaaaaatgacatatactcagtacttaccatgttttaattactgtcttaagggcttaatggtttaatatatattagttgacatatctccaaacactctttgaagactgtatggttgtttctaaagctgatatttgctcagttcagatcagtactaagtaactcagttgagaatttcacctagatctgtagttctgcaaacttttgatcctaagaattatgatatctttctttacaaggaaatacaaaccgtgaaatataaatgtgattttaacagatggattgatgcctcacactaacacacctgcctagaatgtaagggaagattattacaattgcatattgtgtagttttgactttagtccttttgtttaaatctaataaactgttgctagcagtcttcaaatgaacaacacagatgcatttatgtaacagtgccccatgaccaaaagattatgtggtgtcttactatctatcctgttctacaatattaggtttgtgctagtcatacagctgttgctaaatagagactccccagaactgtctgagttaatattcactccaatcattctgctgccctgtggagtattagagcatgacagggctgtagtcacatttcaaaggcagaggacttcactgttcttagatcacacacacctaatatgctagtcctacataacttgctcttttttttctttgctattagtctgctcttgctatttgcagtcatttgcccttcaggttttacatctttctcatacatttcaaaatttaattaattttgtgtattttgtaactttaaatcacttacgttatcttgcaataaagaggagtagggacttcagaagtatttatttccttaaaatatgttttctgtacattagggggcactcatgtttttgagggaactaatttcaatagcctgattttttggtcttcattttaaaggtgaagcattatattctttgaagtgtttttctaggaaatatttaaaggaaacttaaccgattaccttggaaattttacccattatcactttgacacatgtagagtattggattttaggaaagtggctaaaatagctggattatttttatttttatttttagacggagtcttgatctgtcgcccaggcaggagtggagtggcataatctcagctcacttcaacctctgcctcccaggttcaagcgattcttgtgcctcagcctttggagtagctaggattacaggcacacacacacaccaccacgctgggctaatttttgtgtttttagtagagactgggtttcaccatgttggccagtctggtctcaaactcctgacctctagtgatctgcccacctcggcctcccaaagtactgtgattacaggcgtgagccactgtgcccagccaaacagctggtttaaaatggtgagggaacataatagtatcaattcctaaatgtttacatatttgtattatattgatttaacttattacaagcacattttacttaaatagttactaagtaaatttgtttataaatattttcaacaagaaactttactttggtcttcttatctgtgaaagaggaataattattaaaaaagaatatctcaacattatactagggaccaaatgagataatacctgaaatttaatttatacatggaatttacccatatttgtacttcataaatatttttcataattgatgtaattaatgagttctacttagactatttttgataaaattcattctagcaaacattgaatttcctccctagagctacttctattagtttagatttttctccatctatgaatatgctttcaactagccttaaactaacaacaaaaagaaatattctgcaaaaggaagaaagatttttgcaaggttaaaaaatgtattgttagatgtgtgctaaaatcttaatatatattttatttcaattataaaagttatcattttctaattatttcttctataatagttttaacatctttcaaccacatcttatctagaatatgttagtttgggtaagctagatgaatcataacaatttattacacacaggaatacaagtatataattaaaatattaatgtgtatcagtcagctattgctacagtaatgctgtgtaacaagtcaccctaaaaatcagtggtttaaaacagtagcaattaattttcatactcatgggtcatggggtgaccacattgtggctggccaaggatgtactctaacatctaggctccaggcttccagctgtagactacagattggattcaggtatgctgcttatgatgctcaatcttctgggtctagcaatcagccagtgcatgtgcccatctccatgcatcttattctgtgatccacgtagaagatcagtggcttgctggggtcattttcttctcatggtgaatcaccagggttgaagaaggcaaactgaactccacaaatacattttgagactctgcttaagtaacttacactaacttctcattagccagagaaattccatgctcaagttcagtgtcaagatgagggcaagtacaccttgccaataatgaagctatggctatagttgtataattatatcagagacaagtgaagagttggaaagtctatcattgaatttaaatggtttgttgaatgagatgtatgcagtaagattcaatcaaaaggcaaataattttgttctcacttcaggtcttcagctttccataaacctctcctatctctgggtgaaataaaatgcatatcccctatgttttggccaatctgacataatcaaataggaaactcaaactctaatatagttcaaactgcatattaaatacctccaagggtgcttcaaaaactgggcccaggagaaaggtgacggtgaacggatatcatgtttagggagaaagtgacaactattggtgtttgctgcatagactatattagtgtactgtgccttcagatgttattacttagtataaaaggtgaacaaactgggaagctttcttataaaccaatgcagttatacactatgttctttttatgtcatttagcactcatatataatttaattcatgtaatgaaaggattcatcgtagcagaggataccatagaagtggcttcccaacttgtcaggcagcctcctgatgtgggttagagcaacagctgaagataaaattgtgtggggtggcttttggtgcattcctaccagctcacactctgttatgtttcatcagcccttccagaaatcctttaaattactaccttgaaataaatccctaaattagctagaagggattatctttttttggtacagaacacagactgatagactaaatattacacggagatatggaaggccagagaatctcaagaaaagggaaggcctaagttgctaaattgatctggttgggtttgaaagtaataaatatctttctagatagatcctagaattaaatatcagagaacaaggcaatgccccagcacatagtccatagttgtgaagaggtacttatagttctatgcgtagttgcttagaataaagtgcttatcatgtaacatgtaatgtaagactgtgtgttagtctcttttccacttacttagcactctcatagaaaaaataaaatgattagattagagcctaaaattcttcctcaatgaattgtcagaggatgagagatccatgttgcctcttagtagaatctatctcttgaaggcacaatgctattatacaaaaaatcaggaaaagagtctgattctttgggttgccaaattacaaaataagttgtattgattgcttctgaaaatatcttatttaaatttaggacatctgttggaaaagagcgggactctaagaattgatatgtgatgctttggtgtaatcaggtatttctcagtatctgaagtctaagttccactcagcctttcttgtcagcagaaacaatccttccctatctgacaagattgttcctctcctgtctgaagttgttaatatgtcacttgaggtagtagacacacaaagatatattacacagtatgttaatttttatatttacatcttttgttcaatatacatttttgagaatcatctatattgttgtatatattagtaatttgttccatttattgccagacagtattaattaaataaatgcaccacaattttcttattcattctcttattgattgacatttaagctcttttcagtttggggcaatatgaataaaactactatgagcatctttttaaaatcttcttttaatatattaaaaaaatttattgtgtaaatatataggagtggaattgcccagtcatataatagttgtttaatgactgttttacaaaatagtaggatattttacatacatttaagagtctggttgctgctaatcattgctaacattcagtgttatcaatctttttaattttagccattttagtggatttgatgtagcatcttattgtagctttagctgattttcttgattgctaatgatgttgggcaatatttcataatcttactggccattcttctatcttttcttttgaagtgtccatttaagatgtggcctatttgttttattgaaattatttatttattattttaactgaattgcagaagttcttaatatactctagattttaaatttaatcgctagcaatttttatgacctgtcgagaaaattgtgccaccaaggtcacaaagattttatccaatgtttacttataaaagttttatatttagtggccacttacattatcggtcctttttgatgttttagcaattataaataataaacaattccattaaaataaattttatttcacctagtgttcaaagttacacttttgctttccttaggtttatttatcttagaatatcttcttccattcctttactatcaagctttctttatctaccactgtcctctttcaaaatgtgttcatggttgttacataatgctggatcttgtttttacaaatttttaggatttctcttttggtaaatgaatttaacttatttacatttattttaatcagtgaatagatacaatattcttctgtacatatgcaaattgcataagtttgactttttgtgcttcacttaacatctcatttataaaggtaatttaaaaccttttcctctattacttgcttgacataatgaaaatttccttcctgtcaaaatacctggcatatattcatttcctgattgttccctcagtactccaacctccaaaaccatcatttggtattgttttattcagttatgcattcttttgaatatttttgtttattatacatttagataatagtataattcagtaagttatttactgacccttacacacaatttacgtattagcatcttcttagatttatcacaatccttttttggttatttcctccatttataattttgattagcttcttttgttgtaaaacttttgagactttttgtgttattaaaaataactttatattatatgtttatttaaaattagtttgctagtataaaattatggcatttatttatttaagttatttttccttaataccttgaaaatgatgtaacactgttttcttgcctgcagtgtaagtgattcctcatgtcaataggttgcttgctcatttagggcaaaagctttctctagaagctttgggaaatgtcatggtattttagatactcttgcttgaatttcactataatttataatttatctagatgtatgtgtgcatattgataaatctttttggattgttttttatcttgtatatatatataaaagattatataaaacgaattttctatcctttgtctatatataaaatataaaaactatatgtaaaactatataaatcttcatatataaagggtcaagcagagagacatttagtataaggaaatggctcatgtggttgtagacttatgaggttgtatgggctggcaagctaaaattctgtaaggcagtccaatatactgaaaataggcagcagttaaatgctgcagtcttgaggcaaaatttcttcttcaatggggaacctcaagttttcctctgaaagctttcaactgattggatgatcctcacccacattattgaggataatctccttcacttaatgtcaaaaggttgtagatcttaaccacatgtataaaatactttcatagcaacacctagtaggtttgatttcattaaataactggttacggtgacctggccaagttaatatataaaattgactatcacagctacctttccagttttaaggaggcactgacctacctagtaaatagggaagagaaaagatcccccaagcattccccatcgaagatgtccaatgaacttatctgaactgcccattttcacacacatggagaaacaatgactttcttctttgccaaaagttcataattttacattttgttctttgatccatcaatgtctttttatttatattgtatatctaggactgccttggaggaaggagccaaatgtccacatgagttttccatattctctgaaaatagaagacttcaaagaagtttgggtacaaaaactacattaaacttcctttcaatttatctggaatagacaagca

SEQ ID NO: 579 - DNA, 104910 bp, Homo sapiens
catgccaattccttccctgtttaacacaaaataacaaagaaattgagataagaaaaatgttaatgtagacatttggcctggattaatagatgtaacaatatctaagtggatattactaaaagaattaccatttattgagctctagatagtgtgctctaggcagtgtgctaagacttggtgtgtgcatgagctcacctaaaaatctggttccactattagttctaaggctgtagggaagctacataacttcctcaagctatgtttttctaactcagagacagataccttaaagatcatctgctgctgcctcccctttgacccactaacagagactacaggttattaagcaatataaaaaggggttattaacgactctgttttttgctgcactcccctcaaaaccgccgagctccataaatcttaaagtcaaacgctcttagcctactttattttggtacacaccttagaaacaaacagaactaacaaacacctgtgaaggcaaagatcagctctgttctgctctacacggcctctgcagcagctagcagtacttagctctcagtagcacacactccaacagcaacttgtttagctgttccttacacacacacacacacacacacactcagactctgaagcttcccaggcctctccatctaactaccaccatccttacctcttgctgcaaaaactaactggtcttcccacttcaatactttctcaactcagaaggccaagtgttctttttaaaccttaaatcagaacatgtcactctcctgcttcagattccccaaggatttcctacgcactgcaaataaagtctaaattacttacgatgacccaaggccctacttgatttggcctgcttactttccagattgctcactaggacccagcaacatgagtttcccttcagtttcttcaggagcccttctctgccaggtccttcctagctgggcctttgtccttcttcactgtctgccaggaacgctgttcctggctcattcacgtggctagctcctcctcaaacttaaggtctcagttcaaatgtcatctcagaagagtctttccaaccaccctgcatataaggtaagctcccactagttactctcattggcatcacccttttggttcctttataggtttatcataatctgaaatggattacgtacttcattttatttgagtatattctgtcttctctcactagaataaaaactacctgtttgattctctataatatttgttgaataaaataaacaaactcccattcatgggtctgatgttttttaaaataaacaagaaatatacaagacttatttgtacaggacttatttgaagcaaagtttgaaaatctactgagagacataaaaatctatgagaacacaggacagaaagtgcataacgctgtcaatttccccaaacttcacctacaatttcagtattcacaatcaatattcagtattcaataaaaatctctatgatttctttttgaatgtcacagaatgattctaaagttcatctagaagaacacatagaccagaattgtcaaagtctgaaaaaaagagtaatgaagaggtaactaaccccatctgcattaaaattataaaatgatagtaatttaaagtgtatggtaatacacaagagacaaaaataacaagaccaatcagaaatagtcccaaacacatttagtaaatgacaaaagctgcaattttaatagtggggcaaaaaatggattgttcgctaaatggtgctgacacaactagctagttggggtagaattcacacacaattttatcccccaaaatatgtctcacttcttataccagaaaaaaattccagatggatcaaacaattagaagttttaaaaagagaaggaaaaggaaaaaaagaaaccattgaagtattaaatacaatctggggacttctttgttttaaaaatacaaaaaggcatgcagttaaaagtcttcctctcactcattcttcttactatgacaaccaatgtttccaagtatcatatatcctgtgatatacaagcaaaaatgtatacattgtttttcatctttaaagcaaagacacatagaggcatataatgttcctcactttgtttttctagtttagtagataggtgaatattttacattttggagcacggaaagtcttaagtagagcacaaaacacaaaagtcacataaataaattaataacagtcacagctaacatttattatttacttactttgtgccagccactatgcctaatgctatttacatcatctccattttacaaataaggaaattaaggtgtacagaggttaaataatgtgcccaagttcccatagcagcacagtgctgggtttggattacaaaagaatagctagggggatatgagcacacgtacgaaaaaggtgagtaaggccaggcacattggctcacgcctgtaatcccaacactttgggaggcccaggcaggtggatcacctgaagtcaggagtttcagaccagcctgaccaacatggagaaaccccatgtctcgtaaaaatacaaaattagccaggcatggtagtgcaggcctgtaatctcagctactcaggaggctgaggcaggagaatcacttgaacccaggaggcggaggttgaggtgagctgaaatcacaccatcgcactccaacctgggcaacaagagcacaactctttctcaaaaaaaaaaaaaaaaaaaaaaaaaagaaaagaaaaagaaagaaataaaaaagtgaatatgtagagaacttttaacctgttaaaaaccagtaaccccaacagaaaatgaacaaagaacaaaagtaggcaatttataaaagacatatggccaggcgcagtgacgcacacctgtaatcccagcacttcgggaggctgaggtgggcagatcacctgaggtcaggggtacaagactagcctgactaacatggtgaaatcctgtctctactaaatacataaattagctgggcatggtggcagatgcctgtaatcctggctacttgggaggccgaggcaggagaatctcttgaacatgggaagcagaggttgcagtgagctgagatcgtgccactgcactccagcctgggcaacaagagcgagtctctgtctaaaaagaaaaaaaaaaaggccaggtgcggtggctcacgtctgtaatcccagcactttgggaggccaaggcgggtggatcacctgaggtcgagagttcaagaccagcctggccaacatggagaaaccccatctctactaaaaatacaaaattagccgggagtggtggtgcatgcctataatcccagctactagggaggatgaggcatgagaattgcttgaacccagggtgcagaggttgcagtgagctgagatcaagccattgcactctatgcactctagcccgggcaacaagagcaacactccgtctcaaaaaaaaaaaaaaaaaaaagaaagaaagaaaagaaagaattacaactctcttcataataaaaaatgttcagcctcaatggtgattgacaaaaggccatcagaatcacattttttcagttcctaaattgtcaaaatgttttaaactgtaatatctagtattggccagggcatggggcatacctgaatactattggtagctttacaaattggtacaacaaccttttggaaggaaaatgtataaatatctatccatatctacattattcacatcttttgatttcagcaactccacttctaggaatctatcctacaaagctgtttgtacaagtacacaaaatacatatacatacgtacatgtgcataaatattcatacacacacacacaattgtttactgctttctttttctggcaacaacaaaaaaaaaatccagtgaccgtatgttgattaagcaaattatggtattttctttttttctgtttgaaacagagtctcactctgtcgcccaggctggagtccagtggcatggctcactgcaacctccacctcccagtttcaagtgattctcctgtctcagcctcccaagtagctgggattacaggcacatgccaccatgcctggctaatttttgaatttttagtagagacagggtttcaccatgttggccaggctggtcttgacctcctgacctctggtgatccagccacctcagcctcccaaaatactgggaaaacaggagtgagtcaccgtgcctggcaaattatggtattttcatgtactagaaatggggtattaagttgctgttaatgattgataactctgaaataaatagacaaacttggaacagtagtatataaaagaatagtatattatgatcccataatatagaaaattatacaaacacagaaaaaaaaaatggaagaatatgcaacagtctcagtagattacatccaggaagtggttctttcaatttcattatatataaaaaataatgtattacttataattagtgaaagataagattttaaaatagcatatcctccttcatgcattaaaatgattttgtgtggatataaagtaacgtctttctcccccctcaacagaatgtatatactcccacatcaggtatatttacgttctgcatattttaggttataactcctagatagcacaagttttgatttcattccaaatacctccaaatacataaaagttattgtaattaaaaatgaatttaaaaatcttaaaagtaatgcaaagttaaacatctttgaacagaaactcaaagtcatgatgatgactacttaaacattttcaaaattacataaatctctatgttattgccaagggaaatgaattgcctaaaacaaattactctgaatgtgaacagtatacgacagtgataatggcaagaagaatatctgtcagttcaaccaagtatggggtaaaggggcaatctataagcataaaggtgactctcatcataaatctgagtcaaattttcctagaaaaatgtaaccttctccaggcgcggtggctcactcctgtaatcccagcactttgggaggctgaggcaaaccgatcacgaggtcaggagatcgagaccatcctggctaacatggtgaaaccctgtctctactaaaaatagaaaaaattagccgggcgttgtggcgggcacctgtagtcccagctactctggaggctgaggcagaagaatggcgtgaacctgggaggtggagcttgccgtgaaccgagaccatgtaactgcactccagcctgggtgagagcgagactccgtctcaaaaaaaaaaaaaaaaaaaagaaagaaagaaaggaaagaaaaatgtaacctcaatatatttggttttgatatcagtttacttgtgtataacaaagaataaaaacagccaaacagcccaaattttgttccttgagtatgctgtaatgggggaaagaaatccaaataagttgggaatcttgacgtttcctttactcctgactaatctacttaagaatttaattttttatataaaactagtcgatattattctttcaaagggagtcctaaattctattataatcaaccaactgttccatgtttcttttcttttatttatttatttttttttgagatggagtctcgctctgtcaccaggctggagtgcagtggcacaatctcggttcactgcaacctctgcctcctgggtttaagcgattctcctgcctcagactcccgagtagctgggactataggtgcgtgccaccatgcacagctagtttttttttttttttttttttttgtatttttagtagagacagggtttcaccatgttggccagaatggtctcgatctcttgacctcgtgatccgcctgcctcagcctcccaaattgctgggattacaggcatgagccacggtgccggccaatcttcccatatttctaatatccagttttttcctaggattgaaactactccaaaatttcctgaatacataaattaaaacattattgcattctaatattatctagaaccatgagtgctgtctaggatgaaccaatcccatatttactttctcttcctcccccaaatcccaataaacagaactttttttttcttttttaaagaaatgcttttaactgggctcagtggcctgcacctataatcccagcacttcaggaggccaaggtgggaggatcacttgagcccagcaatttgaggtcagcctgggcaacataatgagaccctgtttctacaaaataaaagaaattgaccaggtgtggtggcacacacctgtagtcccagctactcgggaggaccacgtgagcccaggacttggaggctgtattgaacaatgatcacaccactacactccagcctgggcaacagagagagaccctctctgtaaaaaagaaaaaaaaagaaatattttgataatttactaaatacagctatgttagtcactgacattggtgaaatttctacctgttttttaatttccaaaaactattcagcatcaaactaccatatgtgtatcagacatcttctacagcatccacactaactctagctgctaagctcttttatgcattcaacaagtatctactactcctgggcacagggtgttattctgggagtgggaaaagaggaaaaaaaattaaaaactcagatacagacatgcctacaaagggcttatggtctagaggcaaaggatcaagagtttccagaaaaaaaaaaaacattttggagaagagggaataggagagacacttcctggatgatgtaatatgtgatcaaacccttgaaaaataggataaatttagatgtagtagagtttggaagagtaagggaggaaaggagtattccagaagcaagcatcgtaacaagaaaaaacaaacaaaaaattcttcttaatgcaacacaaaatagcccaagtagaataaagaaatatgccatgcttcaatatttatgtaaagcttatcagcttaataaaaatatgccttttcctttacaataaattttataggctgggcatggtggctcatgcctgtaatcccagcactttgggaggccatggtaggaggattacttcagcccagaattcaagaccaggctgggcaaaacaatcagatcccatctgtatttttaaaaaattaaaataaaataaaataaatgttatagcatgaatacttacagaaaatgaatactacaaatgagctttttaatgtaaaaaaaattcataaagaatacagtcggccaagtgcagtggctcatgccgtaatcccaacactatgggaagccaaggtgcagataacttgaggccaggagttcgagatcagcctggccaacatgacgaaattccgtctctactaaaaatacaaaaaattatccaggcatggtggcatatgcctgtaatcccagctacttgggaggctaagcacgagaatcgcttgaacctgacaagtggaggttgcagtgagctgagattgtgccactgcactccagcctgggcaacagagcaagactctgtcaaaaaaaaaaattcatgattgtgctatttatctaagcttttatattaataaaacaattgaaatccttcatacttaaaaaaaaatccagaagcctgagagtaggcaaaacaaacaatagataatttacaaaataatttaacctatttgtaggctgggtgcggtggctcacgcctgtaatcccagcactttgggaggccgaggtgggcggatcacctgaggtcgggagttcgagaccagcctgaccaatacagagaaaccctgtctctactaaaaaatgattttaacactgtctttatttcccaaagattactgaagtcatgtgaaataaaaggcattagagattctatttttctgacaaaatatttaagagccttccttttcttctaagccaagtaattagggctcctttatatatccatcacatacagaacacttctagacaggaaaagatctagcagttgtaagtttttctttctcattttatgaatcctaacacaacttccacagaccatctatgacatgaactttctgacttttcctgtatttccctctttcataatcagtcattctactttagaacaaaaatttgccatacaagatcctctcatataacatttctttccttcataacttttcttaccataaatgcatcttcatatccacaactttctttagatctctctccctgactgatttctgatgcccaccaaaacctaaaaggtcagataacgcaaagcaaaacagaggagagccttagattttgagagagacctgtctgcctgatgttcttggggttccatgaggacaacagaggtttctcctaaaatggggttagtagcaccttctgtttttctttaaggagtcccagcctgtcagaaattaccttacgtcctgtcatgtgggcactgattggcaacaagacagactagggaacagctggcaacaagacagacaactgagcagaaaaagaaaaacttactacagtccccactgtaaagatggataaagtgaggcaccatgcagtttaaaaattcatgttacatagagttgggctccacagctcactctcttaaccatactgtaattttgctgaatctatgcccagtgactgatgcacctgtatggtaccttatggcccccttagtgcttagaacctgggtttcattcctgctctacagctatataatttaacaattttcctctgaatttgttggattctaaccctatatttctaaaattttattaatattactgaatcttaaagggagctgtgatgtctttagtctttagaaatattaagcctataaacaaaggactatatgaagttaaactgtattcaaatttctacatgatttaaaacattgaggcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaacgaaaaaaaacattgaggcaaagtattaagaaacacacctaagaaactgcaaccaatctactctggacaaaaatttagatactatctcttcaaaataagctacctagtggtatttatacatattcttccatatatcaacagtatcttacatgctcatagtcttaaaaataactaaaaagtgtcagaattataggccttacacgtttctgttggcttgaaaaatgatacgaaatgcataaacttctggagtgaccagtttaaaaaaagagttcataccaaaggtagtaatactaagaatcaaagagggctaaacactgcaggttcttaaaggagaaagttaataaaaccttgtttttggttgtgaatctttgccttaacaacattatacacatgattccctcccattctttttcctcttgcaaagatgtggtgatgatccaggtttgctcatgcacatgacaatactcttgaaaataggggcagagaaaaatatgaagggaatatgggtcacttaatcatctcataaattacaacttattacccctgtgactcttgcatagctccagaaaaaatatgtgagagagatgaaatggctgtttgctaccaatattttatgtgatgcttcattttttgattccttgaataacacttacaacgcattagcctatttatgccagaggttgcaattttttgaatttttgcataagtgaaaaatcagaccttgtcgatgacatttagcagtaggatataagtaattcccacatgcttagcgtggaacactaggcataagtgtgttaacacaattatgaaagcatagctttcaagtaactaattatacaactgacttttttcctcatctctaaaacatagtaagggatcagttatttaaaaaatacaacagtgacaactattttatttttaactcagttttggtttgttaaggcccttgcttggcataaaaaaaaaacaggaggagaaacaataatacaaacatgaaatagaagcaatagcaaaagaaaatgaagaggaacaagaaaatgagaagaaaatacacaatggaagaaaggaaaaggaacaggcgtgggaattagaaggctcagtatgatactttttatcccctcctcgattcataaaatttgagtaactgcaagagtattacaagagaaaacaagcaaaagtatacacaaatagtcaccccctatattttgttaagaatgagagaatgctgccactcacgcctagctcaggcaccagcaggagggcacactctagagatttcaggagaagagggaggactcctctttgccctaggtgtaccaccaccactgccaccgagacctttgttacagcatccacaggttcctccccaccccagaacgggatgggccctgcagtgttcctactcccccgtcccggcccccagacttcctactgctaccaccactagcgccaatgccaatacaaccagtcaccctcaacgtaccagcccaccctaccaggctcctaccacctggcccccgtgggtgccctcataccactccagtcgagctgcggtctccatctccaccaccaactgcatgaggcaagctgcagagccacgtcatctgctcgaccctaccacaggcgactcctccttctcctccttcagcctggcttggagcagctgggcaggcaaagccagaagatcccaaaacaggactcagggagtggaaccgttagagcctcaccttctcatgctgatgactgggtgtcagggatcagtttcattgaaggcactcacacccaccttccaaagtccaacctcttcttctggcaaaagctggccaggaactggggcctggggtgggagtgagtgccttcactgaaaccggcccctggccaagtccagctggccaacaattgctgggcccaccaaggctgccctcctcgcagagcctgagtaggagaaactcagacccagccagccctccccacccaagggctggttcccatacctgacacctccacccacagtgccctgtaccccacttcccccatcatgcccactactccctgcctggtagtcccaggtggtcttcgcaacacagagcatgagcacggggcaggaaaccacagtgggtgtggaggccctgccgtgcaatctagctcgcatgggagaaaatcgccttctagagtctggagtccaagaagaggagaaccatcccttacttggaggctaccagaagaaggaggtcactgctgtcactgccgctgccacctcctcagctcgccaacgccgctggcagtgtagcccccatggcacccctaatctgctccctgccactagcagtgtagcccatggatagcacatccaacacaccctacagtttcagacaatgtaaccccaatacccccccaaagcactccccccacacctcagggagcataccacccaatagtgcccacaatctgacccagccacgggcagttcatctcctgatggtgcaccccccagtcacaggcagtgcagcacccaacaacgcccctaaaccacccccaactgccagcattgtagccccagataactccacccaacccaccccctgccgcaggcagtgcagcagaagatagcacccctaatccttcaccagccgccggcaatacacgctagtgtacacaatctgcctccccccaccacccctgccaccacgggcagtatagccccagatagccagccaacctgccccacagccagcaatgcaacaccagagagtgcccccaaccagaccactgccacaggcagggtagcctctagcagtgagccccaataggacacccaacccttgcccccagaggcgtacagggcaggcacggaaactcacctaccccatcacatttctaccactgtggctgagctgcagtctccgacatcactgacaatcacagcgaggcgagccatgatggcacaggttccagcctccagcatgtggcagtgcctcttccttctagttctccagcccagcagaagctcctgctgcccgccgccctcctactgctctatcgccaccaccaaccgtagcgaggtagtgacccaggctccaggctccaggctccatccatcctccagcctccatccatcttccaacctccagcaggtggaaggttgcggcctcttccagtcctctaagctgggcacagagtagctcctccgctcgacacagaagagcctgaaatgacctgacatgacctcagcataagaggttatgcaaatgcagttcctggattacatgttctgattggacaagaaaaaaaaacctctaggcctactctgattggactttattttcatgctgtgattggttgtgttaagacttgctcttatccaatcagaacatgatcataaagcccaatcagagtaagcctggaggtttttttctcatccaatcaaaacatgcagtgcaggaacctccataggcataaccgcagtatataaatgatgctgaagcgtgatcacgttttttcaggttcctgtatcttcctgtcgagttgctggctgcccgatgtagaggactaggaatcaggagtcagtggccgtatgctggaggctggagccgagggagcgtggctcccctcgctgtggttgttggcagcaacggagagatagcagcgcggctggaacggtaggagaaggaaaacagttttgggatagatggaggggattaaagacggtaattagtgccaaagcaaaaaaaggatagcttagccagagaaggcaatgcaaaaagatggcggcaaaaagatggtggggaaaaaagtttttggctagatagaggtgtaaaaacagggtgggaagcgggagggaaggaatattttgcagaaagacagtgggtaaaaagtttaagggtagatggagggggtaaagagggtgtcaagtgggaggaggaaaatgagggaggtgatgggggaaaacagggcaagcagtagggagagaaggttttgtgaaaagacagtggggcgaaaatacagtgggtgggggaagttttcgggttgaggagcaaaagagggtagcaagtgggagaagggaaaagagggtagccagcaggaggaagacaaggttttgtgaaaagacagtggcagaaaagaaagacggtagagaaagaaaagacgatgggtaaaaagtgtttggatagatggaggggggaaatagggtgagaggaggaagaaagagggtggcaagagggagcagggatgggggttgggaaaacgacggaaaaacagtttggggtaggtggagtgcaaaaaaagagggtggcaagcaggataggggaaagaagagcacgagcggtaaaggggggagactttgaaaagggggaagttttggggtgtagatggagggggaaagagggaggtgaataggagtggggagaaggctttgtgaaaagacgggggaaatgtttttgggtagatggagaagggaaagagaatggcaaggaggaacgggggaaagactatgaagaaaacagtttttgggtggatgaagggggaaaagagtgtagtgagcagcaggagtggagagaaggttttgggaaaagatgggggaaaatgtttttgcttagataaaggagcaaaagaaggtgatgagagcgggagggggaaaagagggaggccagggataaggggaaaagacggtgggaagaaactggggaaagggtttgggtagatggatggggaaaagggtgttgagcaggagagtagagaaggctttgagaaatcagggtgggcaaaaaatgatgaagtttggggggcagatggtggaagaaaaagggtggtgagagggagggggccaaaggcggtcgggaaaagaaggtagggaaataatggtgggggacaaaggtttcgggtagatttttttaaataagatcatttgtatttttgcttttgagcagtttgagttctttatatattttgtgtatgaaccccttgcctgatgcatagtttgcaaatacttgtttccattctctgggttgtttcttcattttttaaaaattttaatttaatttaattttttttagacggagtctctctctgtcacccaggttggagtacagtggcacgatctctgctcactgcaagctctgcctcctgggttcacgccattttcctgccttggcctcctgagtagctgagactacaggcgcctgccaccacgcctggacatttgtctttttaatagagatggggtttcactgtgttagccaggatgctctcgaactcctggcctcgtgattggcgcgcctcagcttcccaaagtgctgggtgtacaggcgtgagccaccactcctggcctgtttcttcattctactgactgcttcctctgttttgcagaagctttttttttttttttttttttttttttttttttttgagatggagtctcgctctgttgcccaggctggaatgcagtggcatggtctcagcttactgcaagctccgactcccgggttcacgccattctccagcctcagcctcccgagtagctgggactgcaggcacaggttaccaagcccagcaaattttttgtaattttaatagagtcagggtttcaccgtgttagccaggatggtctcaatctcctgatctcgtgatccgcccgcctcggcctcccaaagtgctgggattacaggtgtggccactgctcccggcctggaaacaactttattttctagtgttgtatttgtatatatacttaaatagcctttagttttaataaagttgcttttaaaatatgtatcttatttttcagaaatataccctaaggcatgtgattagttgggtggcatgttctttagtttttacaattgaaggattgtcattcctttatacaaaaaaaaaaaaaaaattaaaggtgaatttttattatatactagaggaaagaaggcagatactaaataataaatactgtatgcttccatgtaaataaaatttgaaattcccaagacaatgcattaaacccttctgtggttgaagttgggaatttcattggcaaaggtcatgcaataaatgtgtaggtgaagggaatattctatattcgattgtgtaggtgattatctagctttataaatttgtaaaactgaactggactaaaatgtgtgccttatacgcaaattattctataaaattgattaaaactagttaggagagaatcagtcaaggggaaaagaaagaaaaaacacgtgaaaaaataatgccaatgcactagaattgtctttgatgacatgaaatatagcctggccttctcttaattctttttaaaatttatgtagatttctcaatcctttgatacttttttctcaacacaccttatattctcgtatatgttgatgtatggttacataagagaggactcttttacagttggactggaacagcttgatatttatatctagagatgcattggaagcataacactgaccatgagcaagatgtaaatggcatatgctagttagtgattcataatctgttgctttaagtttcgtgccaactggtctacgtcgttgagaatgtttagtttgatggtttacacaacgtggcttaagaagtatatgaccaacaatgtatgagggagcctgctataaagacttttctacacttcccttaaattattatagtaagctcaaatcttgaaggttcataatatacagataaaatgtgtccgtgagactgagaaaggatcctgaaagacagactttcaatgatttcctgcattttatttctgttgtactttatctttacctttattaaacactaataaggttcttcttatagggcctcacaggcctttttagttttccaacctattcatacttggtgcaaacctagtaattttttgcatgatagtattgggattttactctgaggctaggtttcaaaactgtaagaacagctttctggaattgtatcattttcagtctttccatgtgttccattgtcccagccacacacacaccagataacaaaacgaaaagcaacctcaaaaggtaacacacctatagtagatgtttttacctcttgtaaaatctaaggaaaatatactaaaaatgaaggcatcagtaaaatagtatcactttaggttgacctcgagtatttcaacatcagtctagcttcagaacaatacatttgcaaggggaaatggggtacttttgtggttctttacacgtgttatttcaattgaaatagaaaaaaagaactaagttgaactaactataaccataaaaagaaggttttatcagtattgaaataaaataacagaaaatgcatttgtgggtctgacctcaggacggattttaaatagtcaatgctacctctctcattccctcttctctgagcatcagctttattcttattccatcttacttaatttggcatgacagatacagactcattcttacaacagacaccatcagaagtgaaacctttgctccaactcttgaaaaatctgagatgcattttgactattctcagatcatggatctattacttggatcaaaaagtactgcacagggaagtagatactataatctctgacattacagtttcaaggttggagtgacaaagggatagctcccataacgagggagtatcatagaaatgatattttcatggtcatacttttgtgaactaggcagacatcccttcatgtcaactacatctctactttgaacagataaatatccatgcatatacaaaattatacagtaatataagcatgcttttcattaaaattttaacccaaacagtctatttaggagaataaataccgatacaggagataattctgcttgaatgatctttacccttggggagacataaataaaataatgtcatactttattatgaaatgactatgcagcatatttatgaataaactttcataataaatttctttattgtctaaaataagcacaaaagcccttttagttaattaatatccctttttaatatacagaataaatataagaaaagagcacaaatggtattatgccagcacacagaaacaatttcagttaaaagtcaatcctgtattttgagaacctgacaaaatcataattgaaaatagtgtattatcttacatgcagatgttgtgtaatcagggacatccaaatcaacttacatccaaatatttcacaattaatctttgacatattctgtgaagtattgtaaaaccatgccctcaggaatataaaagcacaaagggaggcaggactccatatagccatttattcatttcctaaggttagatacaatgaggactgcatcttcaacattatcagggccatacagatattggagcttaaggataatatccaatttcatagcaatctgttaaagtataagccagtcttatgacccaaatgtgcaccataataatttccatcttgagtgatgatgctacaaatacaaaggaatactgcatctctaaaataaactacgtttatatgacatgagaacaatttgatgaaaagaaggcaaactatgaatagtaactttgtttttttaattgttttcattgtgtgtattcatatctgaaaatataataccatgtaattagaaaagttataataaaataagactggaagtcttaactttttatatcaaatgttctgcacacaattatagccttttactgatgatctatggctccaaaatattggtagctataattatgctttgtaaaacagaagctatgaatgccttactacagaaagacacaaagaatcatttccttactcactcactgctagtagaccctgaggcacagcatttcctgcccagatacctgattattaatcccgtttttgttaggggtatactaacattaactaacggagatcggtgcttaaaccagttaacgtaaagaaatgctgtaggaactgaaatattccttttaaattaacaaaagtgttcttctagacagacaaagttacatgaggacccaaatgtataccagaaaatcatttgatgaacatggaattaataaaagaatgttttgttatatggttttagtacttcgttggtgccaggttacagacatgtggccctagatagggtaactctacagaagagaatttaatttgtttacctgcttcactagaaatccaacaattaagtcagtgactctattttccaatattcatttcctccattttttcatctctttttgattgatggtatcatttcattatttcattttcattgacatggaattcattttggctaaaatgactttttgactatttgtatatacatatatgattttaaaatcaatgaacaatattgtttctctatttccaagattatccctctatattctctaaagtcgatactgtgaaacagtccagatatgagtctaggaatggcagtatgaaatactgtaaaactggaagcaacttagtaggtaatcaatagggaaaaatgaaactcaatataattgactctagttaatgtaatgatgcatttattttacatttttcttgcattcctgagataagtcctgcctggttatagtatattatgtattttatgtattgctggattttgatcattagcattttgctgaagattttttccatctacttttgttaaagatattgttctgtgtttttgtttttgtttttgtttttgttttgatgctattgtctggttttgttattagggtaatactagcttcatagaataaactgggaagtgtattctcttttttttcttttgcaagagtttgtaaataattgtattaattcaactttgaatgtttggtagaggcattcttggctagaagattttgttgctgttgtcattgtttcctgaggtggtagttttgattactaacttaatctctttacttgataagattttatatatctccttgactcatttttgctaatttgaacctttcttagaatttgtccagttcttaaaaagtatctaaattttagatgtaatttttcataggtacttttataataattttttatttctttaagtttagtgtccttttaaaaatttcattaatacttgaatagcttctctttcttgttggtcggtctatctaaattgtggccactgttgatgtgttcaaagaaacaatttttggctttgttgaggttctcaattgtttttctattttgtatttcactaatttgtatatctctaatactttcttgtggttgctgtagttttaatttgctcttcttttttcagtgccttatggtggcaggttagagaatgttatttttgagtatgagaactacttttattgcatcacagagatactatgcattcttaaagtattttaacttttttaaagtattttctaatttatcttattatttcttcttgaacccattggttatttaatagcatgttgtttaatttccacataattctgagtttcccaaattttcctattgctgatttattattttactcaattattgtctgaaaatatacttcgtattattccaatgtttaaattcattgaggtctattttatggcctggggtatggtattcctgggtaatgttgcatgtgcacttgagaatctactgttgttacggtgttccttaaatatttaatcagtctagttattttatagtattgttcaagtgttctatttctttgttgatcttctgcctagtcatttgatccacttgtgaaagtgagtattaaaggctgcaagaagtatgttaaattgtctaattaatcttcatttttggaggtttctacgtcaatggattttgaagtcttttcattacacatatatatgcttataattgctatttatttttgagatattggatctttatttctatgaaatatctctctttacctctgtagttacccttttgttttaaagtctacttttttctgatattaatgtaacaattccagctttcttgtggttactgcctgcatcatataacttttccatccttttttttctatgaattttcatttttggatctgaagtgtgtcttctgcagacaatatgtagatggatcttgtttatttaatttgtttttcctccagtctgacaatctgtcttttatttgaatatttaaattcatttttacttgaggttactagtatagttagatttacatccatcattttacttcagttttctgtataccttatgtcttttcattcctctattcctcctttactgctttcttttgaattagatattttttataaaacatttaatttaaatttaataatattttatctatatattttcaatgtttccctgaattgctactttagggtttactgtagacatcttatcacaatcaattttagatacacaacaattctagtgacataagtatatataaatgttacttttgttcacttttgtatactttggctgtcctttttgtgctattatggctgtacacattacacctgtatatgatatatacccaataatttagtgttataactgttacttgatgatatggtttgttgctttgtcctctccaaagttcatgttgaaacttaatttcaatgtgacagcattaagagctggaaccttgaggatatgattaggctattagggctctgtcctcatggatggtatgagtgtgttatagaagggctggagggaattaggaccctttgcctttgcatccttttcactgtatgaaaatacagcattcaccccctctggaggatgcagtattcaaggcacctcagcagacaccaaacctgccagcaaattgatcttaaaattccagcctgcagaactatgataaataaatttctttacaaatttctcagtctctggtatatatatgtatgagcatgaacagactaacacacttgacataattttatgtcttaaaaagataaaaagaaacgtactatgtatttacggcttttgttatattaacagtcttatttattatttcaggtcttttcatttgttcagcatttgaaacttcttcctgacagcagaagggctcttcttagctgtctttttcctgggttattcctggtaaactagctgacttttgtttcaaagcatatgtctctaataaagtgccagtctctcttatttgctttttaccatcacttcattgtttttcgaagtacccttacggttgaatttccccaaacttttcttttgggaaaagctttagtttctctgctgtatgttgtgccccttcctttgggcaaaacttctgagctttggctctggtgattgcagcaaagagagcagcattctcctctcagagtgacggccctactttgagacagggtcactgggatgagaagtagccgttggtaatctcagcttgccactcctggaatcagaactttgccttacagccaaaccagaaagaaggcaatcagggctcagtgttctcagtgcgttgcacccaaacaatcctcattccatgagttagagctggtaggaagaagtgacattctacttcttggccacattcaacaaaagcttaacctcaagaacaggtagtggcagcaggtgggggttcaaatgaaaaattctgatgtactgttactcccagaaaattctgatgtactgttactcccagaaagatactatagccccccaatggggtctagtaaaagtcctgtgttcttggctacattgccttgagtagagtttatatcaagataggctgtgagaaagagaggtaagaatgggttgtggatgaaatgcaaaaaaactctcactgttcttagtgagtttcagtagattttcttgaataaatacttcatcattttctgtgtaccattatgacttttcaagtgacataggtgatggttgttttataattttcaacaattttataaaagatccatggagctcttcacattgccattctagaggtggaacttctgcatttatttcttatgcaaggaaattaaggttttctttaagttactttctcttctttcttctaaaatatgctttggaatctcactcttacagcaaattgggtgtcagtgtatttctttctccaagagaagtctgctagatactcaaataatttttgtttgagattgttatgtttgaaaggttgttttgttgttaaacaaaagacaataggaagatcaacatgaaaccctcacattcattgtatgtataatatcttttcattcagaatgagttacagtatatttgagtgctcataaagctttaaaaagaagtggattaagtaatcaatctccctagacagataaaaaagcacatgatattttggtatttcccaactttcattatttgactttcatgttctagcaaataactttcaacaatttgtcaacgtatttgcagtcatttatattttacattattaattccattatttatgcatgtgttgaatagactttatagagtagatgttgacacactcgattttgtaacaaagtgaaaaattactttgatacgtatttctttttttctgacaaaattctgaagtgcttttccatctcttccaaaacaacatatagaaaacgtgtttttttctcattattaaatatatgactcggaatacagcaaaactaattggctataaagcaaacctttaaaagagaagagtttgatgaaaaatataagcattcttagttatacataagatcccacagagccaacttttttccagatttatgtcccaattttaaactttaattcctactgtctaagcattgtggctaaaagtatgagataattaattactcctgacatccaacttttgtgatcatagtaggtgacattcctttgaaaaaaataacttaaaaattttctggtaaatgttacgtttgtgtgtgggtgcagagtttaattttcataccaagctcacatatcaaagttaagtgttttaattatcttttaagactatgtccttggatgctatgctatatgccaatatttatatatgttgaatatacttaactttcatttaacttacatagccataatgcttaactttaatcagagattccttactaattctgatgaatgttggtagaaaatatgctgaaaataaaatatgttagaataatttttaataaaaggataaaaggaaagaaactagcagaagagccggcaccacagaaagcaaagtcacattctggatccaagcaaagttttcatgagcaaagaaccaacaaattgaattcacgagacagggagcagaagcaagagagagaagaggaagtagacttctttttgtttttgttttttatttgttttctcatgagaagagtgtactagtagtagaagtaagttctatgaatgagatcagaaagacataggtagaatatctggaccctctgtataggataggtagttattatattgtgtgttctggaggtaagatttatataaattcaagcctacaatagtatcaaggcctattaagcaaacatccattagacagcaagaaagactaagaggctttcaaactacaagtgttaatagttaaatgtgaagcaaatatatagacatttgatactatgacaaaaataatatgaggtttatcataatttaatattttcttgtttagtaattatatatagctacacactagtttttcaaaacttaactaatcctctttaaatatatttctatgaaatttcctgctatacttgggatacagttgagtgtaacctcattctgtaggattttttttaaaaaatcatgaaacaacatagtgataaatttaaatagttttgccagttgaatcatgtatgtgataaaaaggctttatatttctgattcctaaatcagggcatggcagtacaaatcataaatcaagtattcttatgtccgttgaataattatagaagaataatgcccaaaccttttttgaatgagggtatgtcatgagcatcaaaagggaaaaaaagtatgaaaatccctaagagttttactccagagagtcatatagattgtgcgttctttagctaacattttaaaacaaatatctgaaatcacttgcttaacccctttgaataatatactattgtccttaagagaaattcagtaatttactaaaggttcttttcacatagccctgacttctctctccagtcacgtgcccttactggtgtctatgacccaaacacactagttgtctctcgatttcactaagatgttctgcattctttcttctcacagcttttatgtctattgctgcttcttcaaggcatacttctctaatatttactagctactgtctattattttgaatcagtttaatggtttatttttgaggagacaagggcaaattttgctgctctatattcccatagtattgtagtcttctctttattaaaaactcatcgggctaaaaattgtttgtgattcccatttatttacctgctagattctaaattccatgaagactggaaatgcaacccttttatttacctgtgtatctcaaactttgtattcttcctgtgagacagtcttgtatttataaaaatgaatgaaatttttgtgtttatatactgcattaccaatacatcttgcactatgaaattttccttaatttcaaaaaagccaaacattacttttttctcatttatatagtttgaaattcttctctggcaataatgtttcacctataaaaagacctttttcaaaaaagaaatacagaatttttcaaaaagaactaagataattgtccactaatctcccattaaatctcttagttctacttccacgaaagatattaccatctatgattaatttggatttcagaggaagaaaatgtagtttgaggaaaatggattgtggagcaatctcaatgctaactactataaaatagcttattacttgaaaaatgaggctattgtatgaattttcactagtcaattggtagcaaaaacaaaatttaagtgattgtaaacatgtcatattttaaactatcttgtaaagatgtaatgtacagagatatatatgttactagcatctggattcagaaaaatatctaactggaaccaggtttaagttgggtaattgtagtgtgtctaataattttaatacaaggtaaaaacattttctgttgaaaatcagttttaatattgagttaggttttatttatattttgaaaatttaaggactcttgaatatccttaagtaaattgcaatttaatgcaattgtagttatactcagcagtatagtgacacttgattaaagccattataaaggaaacataatcccatactgatgatcttcacatttctttgggttagagatcagtttatttcattaagattacagttcaggagaaaggttattgactacatgtatctatagtgttgtctaagcaacagttaggagtttagtttgcatgtttattatttttgagagcacatcaatgtaatgaaatgtatttaaaattgtacccatatatacataattatatatatttatatatatattttttacaacagtgtttttccttggagatggttcaatcaaattgcagaagagacacttctaattagttattaggaaggacaagctaggattgttttcctgaacttttgtgactagcaatgatgtcttacagacgtgggggtctggacacttggatcttcaattggaaatggttaaaacattgttatccaaagaatgacaatggtttgtttgccaagtctttttgttttgttttgttttgttcttttgagatggaatcttgctctgtcacccagacttgagtgcagtggtgtgatctcggctaaccgtaacctccgcctcccaggttcaagcaattatcccacctcagcttcctgagtagctgggattacaggcaaccgccatcatgcccagctaattttgtatttttagtagagatggtgtttcactatgttggtcaggctggtcttgaactcctgacctcaatgaatccatctgcctcagcctcccaaagtgctgggattacaggcatgtgccactgcgtccagctgccaagtctttttgtgttaatattgctgttgaatatatctggtgttttcattcaagaaaacacttaaaagccattttaggggccgggcgcggtggctcacgcctgtaatcccagcactttggaggccgaggcgggcggatcacgaggtcaggagatcaagaccatcctggctaacacggtgaaactgcgtctctactaaaaatataaaaaatttagcctggcatagtggcgggagcctgttgtcccagctactcgggaggctgagtcaggagaatggtgtgaaaccgggaggcagagcttgcagtccagcagggcgacagagccagactccatctcaaaaaaataaacaaaaacaaacaagccattttaggataaaagaacgtttctcagaactatcactgtacacatcttcctgtttcactgattcctcttctctcctttagttttaaccttttgtgatagctctttatgcatcttcttctggggtcattgaagatgtgttctgtcttactggtttctgttaccactaagtacgtcttatctctaaacaggtggtttgattttatgaccactcagacaactctaagtaagatgcaaacatgtgctactttttcctactctacacacataaacttcaaacaattccctcttctgtctgcatctttcaataaggatatagacttagaacgtttaaaatcgatggataaccactctttactgcaagagtggaatactatattggaccatgattatgggcaagatcacctaaacagaatggataactttacactgtgtgtaagtactcactaggcactctcctagtagtgtctctacttgatagagaaaagtattagaagaaaaatgagcaacttcattctcatgatttctaatatgtcatcataaatatgaggtccttcatttctgttaagtagaaaaccaatgatgatactgcttacagaaaaccatctgtccgtgttcatctatatcaacaaacttccaggcaatttgcatcggcacaagctgttatttgtctttgctaatgtttaacaatgtcaggtggttctacttcttcccaggcagcatattctataaaattctcaatgacagttgatactctggaaagatagtatttttattcttcacagggtagaatatgcattacaaattctgtaatcagtaaaatacgtgcaatgaaatggtttcaatttcatgtatgaataatttttatgatggttatctaataatctaaaatatttatatttcaattagtgttttactaataccttattacttccttttaatcaatcaaaaaggagatattacctgtccaaaggaagcttagctatgtattatgcattggagactacattaaggaattcactaggcaatgagttctaggtgttaaaaggggtattaatttaaaaaagaatattaaagatgcgaaattttaaaccctcaaagacatgtgaataaaagatttaaagaagaaaatactgtgttgactgaacaatatttattttttcccaaatgtctaagctttcaaatcagggactaatcatgaaaaaccacatgacttatttttaaattaaaaaccatattgaaatgtatttttctggttgaagagagttttattctaaaaagaaaaaatgtctctgaagcaaaaaaaaaagagaaaacatatgctcttatgtttgctcaagcagaatttacctctgcaactcatataattggtgctataattatgtacagatatattttgatacttcaaagaatctataaaattccctaaatgaaaattattttagattaaacatgatattaatgatcaagacagctttttttgtttataagcaagttagattatattgcttatgaaagtttttttgtatttttattccatggatcatgcaaaaaatcatactagacaatgaaaggatatcgtgttttctcctttttgccttattaccattttttttctgcgcttagttctgcctttgctatatagtgtggaaatataaagaattacaagaaatgctcagatgtctttttcaaacctccaggttgccaatatattcacttcatcactctcatctgattcccacacattcctctatgatcctacagagcagtatgtttgttgtaaaatctaacagaccacccaactatggtttgcaacatcaaaccgtcatgtttcttgtacacaatatattagaaaattgggtttttacgtatcagagtagaaatatatttcatacatatttgaggcatactgttatattcttaaggaaataatatttaattgaacccacatgatttttactatgatgtaattactcactgaccaccaagtctacagccagcctctaccagaatcaagatacacataggtaaattattttgaatatcttttgaaatctggggtgctcaatttgatccatgcatattaccttaattagtatacatctattggtcattgccatactttttaaaatgagatataaaattatacaattatctgtaagttctctacaacatcttttcctagcagcattttacagcagacagaggaggctgccagtaggtagacaaaacaaaaaatagaaacacttcttcctaagcatactttttttcacatgtcataacgtgaatctactatcattttttagttttacttttgtattctgaaaaaatgttaaaattggttattaccactgtctctctgttctttcctaataatgtctttttcctctattgtcagcattttaaaaaacattcttgatctctaacacctttctagaaaattctgctgacaaattaagtggcagcttagaacaagaggagatttaaagaattattgttgataatgaaaacaatgaaatacgtatttggcatgggcttgttgcacgttgacaatatatcattgcataaatgtttgaaatatttttcctttatgaaataattgtcatcaagatcgaagctattgaatatatttgctgtatagcattttgtataaaatagatttatattgctttgagctgaacagatattttcaatgaaattgtccttggccagcgatgttatgtccatctaataccttatctctttcctcttctctttccccaactcacatgcaactgaaagatgctagaagttaacagttctggtaaagtagtcttctaaaatcctttttcatttatgtctagagaaaaaaaggtaccaaaattcaggacagatttttcttcaaggtatcaagagtagaccatatatattttttcaataaatttataaagctatattttagaaatcaaaaaagaaatatttgcattaaaaccattattcccttaaatttttagaggattctgtttgactttggcgtgaataaagtccattctcttatttgcagtgctattagatatgaggagttttagcagagatcctggaacaactgctgcctatcagggtgtgaaatcaatgagatggattccagtagaaactatttactttgctatatctcctcaatatatgtatatacaaacaagatctttgacactggcttgaaatccacagcaagaggtacaccaggaagcatcaaaaactattaagtatatacaaaaatagttgaatgcatacctcagttagcaatgttaacagggtttgtgtcccacaaccattagattttgctacccacaattatcagaccaaattaaagtaatatgagcacaacatctccactcaaggacagtatcattgcaaatttctgctcatttcaaagcaatataaatatgttttatacaaaatggcacatagtaaatgtatttgatagcttaaatcttgatgccaattacttcataaaggagcaaatattgtcaaatatttatgtaatgatgtatcattagcatgcagtttgtgttcctttaacatagtaaatgctttcttctgagagaaaaggggcctcgattcttctatttactcattcttgctggaaaattttgcaaatataggaagaagaatgaatctagtaatttttttttttttttttttggcggagttttgctcttcttgcccagcctggagtgcaatggcacgatattggctcactgcaacctctgcctcctggattcaagcgattctcctgcctcagcctcccgagtagctgggattataggtacgcgccaccactcccgaccaattttgtatttttagtagagacggggtttctccgtgttggtcaggctagtctcaagctccggacctccggtgatccgccagcctcggcctcccaaaatgctgggattacaggtgggagccaccgcgcccggccaaacctaataattctttagaacctcttttgtgcaagccagacattgtcctaagcattttagagacacaatctcatgtatgtgtttgaaaaattatccctatgaaactaatgtttctaaactgtgaaagatacctcatttgctcctttaaattcatgtgccactttttcccattaccttttttaacatacattacgtcttctgggtcctttgacttataaatggcctcagctcatggtgaacccttaacaggagctgcgaaggatgaagagttagaccagcatgctaattcatcttgcttcttccctgtaagtagctacatctttaaccactgattcgaacaaagcacagactgtacaggatgttttactcctgattttgagtaatgcaccttctccttcagatgtccttgtggtaaggaaatggctgctaggaagtgacagattacttcgctatcctttctggtatctctaccccaaccctaatccatccacttgtaaattaacccttcaggaattatactagtctccgtgttctatgtgcactgcttatgaactgacatctgtataaactattgagaattcgagaagcttaactcaaacattgtttgaacatcttatggaaatagagggtgtgtctccacatttctccacatgaatattaagagtgttgatttttactatgttgatttttagcttctgtaaaggtaatttttatttttatacttatttttatttatcatatgactattaattgctcccaggtaatgtggactaaaagggctttcttagtttacacacactcatgcacacacatacacagatatgtatgcacacacgtgagacatttgcaattgtaaaacctactacggagtaaaaaggaaagggcataggcaaaatgccatggcttgcctacaactacaatttggatattagatatttatcttttgttctttcttcatagaactgctttgactgctcaggcttttaggggctccaaatgaattttagaatagtttttttttttctaattctgtggaaaatggtatgcatagtttcgtagggatagcattgcatgtgtagattgctttggacagtatggtcattttaacaatattgattcttccaattcatgagcatggaataattttgcatttgtgtcatctatgagttcctttaccagtgttttatagttttcttcttagagatcttttgcctccttggttagatgtatttctaggtattttaatttttgtaactattttaaatgagattatgttattgttttcaatcttagcttgaacgttattggggtacacaaatgtgactgatttttgtacattggatttgtatcctgaagctttcctgaaataatttatcagttccgggagcctttcgtaggagtctttaggtgtgggataatatcaggtgaagagagatagtttgacttctttttctatttggatgtcctttttttttttctcttgctgattcctctggctagcactttccaatctatgttgaataggagcagtgagagtggccatccatattttgttccagctcttaagggaatgcttccagtttttgcctgttcagtatgatgtcagtcatgggtttgtcatagatggctgttattagggagcatgttcctttaatatctagtgtcttgagaatttttatcatgaacagatgttggattttgttgaaatattttctgcatctcttgagatggtcatatgtttttttgttttaaattctgtttatgtggtaaatcacatttattaaatcccacatgttgaaccaaccttgcatcccaggaatgaagcctacttgatcttggtgaattaactgatgtgctattgaatttggtttcctagtaatttgttgaagatttttgcatctctattaatcagagatattggcctgtagttttcttcattgttgtgtctttgccaggcattggtattagagtgatgctggctttgtaaaatgacttgtgggggagtcctttcttcttaattttttgaaataatttcagtagaatttgtaacaactcttctacatacgtctggtagaatttggctgtgaatccagttggtccagagttgttttgattagtagttttttttttttttaatcactgattcaatttcagaactcaatattggtctgttcagtgtttcaatatctttcccattcaatcctggaagattgcatgttctcaggaatttatttcttctagattttctagtttgtgtgcatagaggtgcttataatagtttctgaggatcttgtatttctgtgtgattggttgtaatgtcacctctcatttctgtttgtgcataattagaccttccctctgttctgttcatctagctagtggtctaacaatcctgcttatattttcaaaaaataaacttttggttttgttaattttttgtatgggttttggggtctcaatttcattcaactccacaatgattttagttactacttctcttctgctagctttggagttagcttgttattctttttctagttcctctagatgtgatgttagatcattagtttgcaatcttcctaaatttttgaggtaggtgtttagctataaactttcctcttcacactgctttcatcatatcccagaaattttaatatgttttgtctctcttcacttatttcaaagaatgtttttcacttctgcctatattttgttgtttgcctgaaagttattcaggggcaagttgtttaatttccttgcaactttgtgattttaaggtatcttcttggcattgatttatattttttcctctgtgttctgagaatgtggttggtatgatttctattttttttttggtttattgagacttgctttatggctgagcatgtggtccatcttgaaatatgttctatatacagatgagaaaaatgtgtactttgtcgttgatgaatggaaaattctttagatgtctgttaggtccagctaccaaatgtcaagcttaagtccagaatttctttgttaattttctgccttgatgatttgtctaatactgttggtgagttgttgaagttccccacaattactgtgtgggctgtctagggctccttgtagatctagaagtatgtgttttatgaatatgggtgctccaatattgggtgcaaatataattaagacagcttagtcttcttgttgaattgaaccctttatcattatgtaatgcctttctttgctcttttttactgttattgtttgaagtctgttttttctgatgtaggattagtgactcctgcacttttatattttccatgtgtgtggtagatttttctccaaccctttacttagagcttatggatgccattacatgtgagatgggtctcttgaagacatcagatagatgggtcttggtttttatttttttaatgttgatcatattttagaaaggtattgagaaaagttgtctttctgataaatgtcatactttagtaagtaacaacttgagattcacatcacagaatttgccttagaggttgagcaataatagctttttgttgactaggcttgtagcttctctaaaatttcagaatctggccgggcgtgatgactcatgcctgtaatcccagcattttgggagggcgaggcaggtggatcacgaggtcaggagatcgagaccatgctggctaactcggtgaaaccctgtctctactaaaaacacacaaaaaaattagccgggcatggtggcgggcacctgcagtcccagctactcaggaggctggggcaggagaatggcgtgaacctgggaggcggagcttgcagtgagctgagactgcaccactgcactccagcctgggcgacagagcgagactccatctcagaaaaaaaaaaaaaaattatctctcaaaaaagttgtatatgaaacttttttttatgttttactaatatgaagatgcatagcatataacggacaagtaataaaatattagttcccttttcagggggagtttttgttaatttttgccaaactcttaaatccatagataactgactgcaattagcaaataaatagagtttcaatatgaatattggttactatttttatatacgttagtggttaaagtgaaattaaaacctttacttgttcaccaatgatacactcttctgagaatcataattttttaatacaaggataatatgtctgtgtatgttggggcagttcataatgtaatggttacagacataatttaaaaaaaatttgcattattaacatacttttattcattctttatttttacttttattaattatttttattctacacaattaacaaaatactaaatcgaaccctgatacgcggtgttaattttcatgctgtaaatactctcttcatgactgaattacaagctacaacctgaggccattaataggaagttggagagatgcacattagcttgccattatatagtgttgccacgatacaaacatcatctatgtaaatatttttggtagcataaatcacagcaaaatatagcgaaatacttaggaaatgatgaatttaagtaatttgttttccttatttttaatataatttaattataaattaaaaagtttatttttaataatttctgtgtctaaaaaggacctcagaatatttctaaaaatttaatagttggatctcatgagttgatatgagatagctctcaaacacaattgtgtataactaaaaagtctagaattatagctagttttagagtcaggaaataaaatgaagtggtcagaattttaattctctcatctagggaatagctaggatttaattttacatctagattgggtcacatgttcatatctggacaaattaattacaaccatccagttagaatacactagtcagaactgggtcatggacaacttctagaatttgcagatttatcaggttcacctaaaccacattgattcaaacttaaaaacattattccatcaaagaaaattggcaaaaagaactgctaaacatttattgcatactctttccaaaaatatacacctacagtataaaatactaactagtaatgagaatatgtttattgaaaatttactatatttcaaacactgtgctaaaaacttttacatattatctcattagataaaataagactatcattaatattatttatcttcattttaaatatgagtaagtctctagttatatttttctatttaagatcatatatggaaagtattaggatggtgcaaaagcaattgtggttttgccactaaaagcaatggcaaattacttttagtttgtcatagtagattgtaatatgtgttaaaatctgtattccaatcttgactccaaaacttacatttttacatatagaatgcaacacacttagtgaaccccacattctcatcattaagagtccattcacttttgttcatggcactcttgatcatagtgtcatagaatattttagctgcagaagaaagctacccattgcctagaacatgaaaataagtgagaggtactatgaatctaggataaaaacagtagaacatggttctaatgtatgaagaatgtcttctttaggagatcaataaatagtaagttgattagacaaaaacatgtgattgactaagtttgaataatgaaaaaaagagaagactagagtggcaagtaataagccgaagctggggacacatgaaaaattagtagaaaaaaacttatcgaaagaaaaagttgcaaatgcctttatttttgtttattttaggtctatatggcttgattaagcttttcttcccaaatccatatattccaggtagatacagtgaacttcattagatttgcttccaatagtttgtagtcattgtttaattggggaatttactgctactccaaatatcatatggaatcccagtcatctcttaatgtcttttttaaaaatgaatttgccaatattttataggtaatacaaggccagaatagtaaaatgatccaataaaggcaagctaactaatcaattaatctgaaaataaaattgtcacctgaaattctactatgtaggggtcattgctgttaaaacattagggccctccactattgtggggccaatttagttctatacactttctgatattctcaactgtgtcactataacttgtatcccttgtcccgaacaccaagtctttttcttattcttctactctctctaattcttaaaattagacccaacattgtctgaaggaagaacttggggctgggaattaggatcttatcaatgaaaatgaagtaatctaaaggtcactggatatctttagatatttatttacatagatgaaatatggctagcaacatagttagaagcataagatattgtgaacagaaaataagaagatgaaattatctcaaataggaagtataaaaaaaatcaaggacatcggaagtgagcctgggggagcaaagtttactctatcttttaaataataattttctttatttcttttaataatacattctttagaaatcataaggctaggtattaaaacttgtgataccagtgtgctcaaattatgtctaccattggagattctcacttttattttttgaatttatattttagaaaaaattacctgtccctgtttaaatgtatattcatcccaatataaaatacataaataaaatgatatagactcaatactttaaaaaaaacttaaattctaacattctgtagttcttccacatctcatttgtaaaacaagtaactgatttttaaattaatgccctataaataggttaaatttatttttaaatttgccctccagagaaaagggttgtagcattttatttttaacacacaaaatctatctagatattgaaaaaaccttgtcattggcagatattctaacagatgatctaaccactgatttttgcctatgatttatggcaattttttatttgaatctgtaggatgtaaatactttttacgctgaacaagtcaccaaacagtacaagactttaagctaaaagtagctaggaaatacatagggaatcttaaggtgtttgaaacaaagattttacgacgcttatcgtctgctgaaagaaaaaaaatcgtttcttcatttctgataatgtcagaatagataggccattgttgcacacataactgagtctgactgtaagaatgaattatcccaagtgaaatcctctaaatgcttacttaacgctataggatgaaaaattgcaagcaagaaaagttgaaaagcaagccttgggggaaggaagagagtatcaacatcacaatgaaatctgcatttggcattttaagtaggatcctgtagcaggatgtagaggagcctgctgtgtttaaaaatgatcttttgcccttgtgtgtatatgtttcagcattgaaataatcagtcctctttcaaatataatttgatagcataattaaagtaccccactagcacaacttttgaagctaaacttttcctttttcttgtgcacttagaaattttttcacttgtatttgatagcccagaccaattgacttagaattccctgcttgatattgtaaagaatttacttctatttatgtcttctaacacataaaatgttctaaactgtcacctctagttatggtagcatgtaggcaatgaagcctaacaggacatctgactaaactagatgtgacatgttagtatcacaatacatcaaatttgatataatgcccttttttcactttacattataaaatatgattttgctttttcgtactttttgcttttctttttagattcagtaatatataaaaatatcaagtcttaaaatttagtgaacccaagacctaacgccttgaagtaattaacaaataagacaccatgtctttgcctgtgcatatgcatttaaacatatttattaatacagtcatgttggagggcgtgatttacacagcatcttttagatattcagaggttactttggagcagcctatacttttgacctttagcaatgttcttgcaaaccagtcattcaattctactggaatgagattaaaacaatccaagtatggctggtattcatatgcttctccttgtttccctctcccctcccaccactccaaggctctggtaaagacatttttgtttttgttctccagtctccttatataggtctaatctattactctttattcaacaatgtgtgtatattgtagtgactaatttcttattaattcctctaccgagactcttctgcaaaattcttgagaaaatgaattcattaattcttcttaaattctggttgccgtttatggttggcccttagattttgggattcaagtctaccattcacagcctagagagacaaacatgatagcagttgttttcttttggataaaggagttaagatttcttccatataaacagttggggaaaaagcagacatatttattaggccctatttaagagtttattcactctgtttaaaaaaatcattaaaaacttcaaaagaaaaagcaaagacagtgtggaagtaactttcaatgctgaacattgaacattgaaacttgaacattaaagcttgaacattggcttacaaacacaccaacagaacaattattatatgtatgtaactttgactgtatgaatttacatgccaacttgtagatttctttgtagaaaagaaaacatgaaagattaacgtatggttttatagaccgttaacaagagctgtattttatctaccagtcttattttaacatttctccccacatcatctttgtatgccagttccacaaaatgtattttaaaccagttttaccttctttttggttccctcattaatgagttgtatataatcttaaaatatgtttatcctaggtttgtgtgagaattatctttttagtattaaacttctaacttttggttatgccccagataacagaggaaaagaaatgattatacttgaagcatttttttattccaattaatctccgtagtaaatctattaaatttagctcaagttacatttgtggaatgactacttatacaggtaatgtgatagcacctgaaaggggaaaggtttccttgtccctcttgcagggcatgtgacaggggaagtggcttgcttcttcagtgccctgctgctcaaacctctcgaggaggatacagatgggcaggctgcagggctccgaccccacagcagtgtccaggggtgaatgtttacagctcctgaagccccagtgggtgagtgtttatagggtgctcttttagttttgccatctatagggttgtgttaaccaactcaattacacgccctaccttgctgcaaggacagagggctttctgtaccccaggttcttgccttgatgtactggaagaattggctcacacctgggcttggagaatgagtgcaaggttttatttagtggcagtgtctctcagcagatgggggagccagaagggagatggtttttccctgatgtggggccgtggagcttctccaactgctctggccaaattctgcatcattctactggccgatggcctgctggcctgccggtatcttccacctgcgtgctcctgttgacatcctctggatgtctatccgcttgtgtgtctgcctgctagggtctcagagatttttatacatacaggatgggggcatagcattcaagggtggtcttaggaaatgcaacatttgggcagaaggcaggtgaagccctagccagggaccatgccctcctttacccagcacttcccttccccacttccgtatcatttaaagggatcatgcccttcccttcccagcactcccatatcacagctactcataaaaagtgtctaccatctggtcgcttcactccaagagatccacgtaagaaaatttaaaagaagatatacaagataataagtgataaacatttatagatagttataataaaatggatcataagaaaggtgaaaggctgtagaaactgattaaataaaaataacgttatctacaaattcagagaatataccattcatactaaaaattaagtgcatattcaacttatgttaaaaatgacactgtaaccactcttctactctcgatgaagtcaacttttctgtcaaatttaaaggatgatactgtacagcatttctcactaaccatattttttcagcctttttctttctactctaacagccctttaatgttctcaaaattcttggctgatgcctcttacttaatgcaccaagcattcaacagtcagctacttggaatgtgacgggtatggtggatatggatgtttcttcagccattaaggacatcaattgtaactgaacagtaaccacagacaaaaaggcttatgagataataactagttctccacaatttaacactctcagtgaaaaccacccatgacttaataatgtaacattctttattttggtagaaatatgaaaaaaatcagattcataatacatttgtcttgaattttttttactcataaagaagaattttatcaggaacgctcatgacttctactgcctcagctttctcttaggcatgattttagatgaaaaatgtttcttaaacgaggttttatattgatctcccattatactcaagtagtccctaacataaaaaactcacaagtacatagtaagtttgaagataacagatttgtaagtttgattttcaatagaaagtactttatcctaatttacttagaagagaatagcatatttagaaatgaaaaatagttttcactttttaatgcaactagttaaaaatagttaactgattctcataaggggaaggtattttgtagtacttaagacaaaaatgatatacttgtaaatattacagatacattttaaagttgacagagtattctcagccattttaagttataatctgtcaaagacaaaattatgccactacagaggatccaagattataggtctgatctgtcagtcatgaaggtttataacaaatagtatagattgaagcagatcaagcatgaagtccaagaaaatcgtctaatgctctgttgtattggcaaattccaaaggtgtggagactataaaattagaaagtggcaagtgaatagtttgagagactgtgggctcatcaatggagacatgacataaacaacagaattactttacaaaaggaaaatggacattttccagagactatcatcccacctctaattgctttaactagtacacaaatgacttcctaagatgacaagtatcaatctttcatcaacctttctctgcagtgatgcataaaacagatgatgttaagatatccaatggaagtgtcagggtcaataacataggacataataatataaaatcactgcagtacttattccactgttagaaaaaaagataacaaaaaataacataccagattactggcgttgaggttgagcatgactttgcaggaatgaccagggcctaaaatatgcctctcatttatttcaatgagtatttatgaagccaaaactctcttcatatattagacaaggtgttggagaaaaaagaaagaaaagagacgtgtggtccctccctgctgtcacaaagtttactcaagtaacgtgtactcaagcaaggaagcagcatagcatattgcaatagtgtttcaaaaggaaaatacaggttaactgcagcagcacatttaggagaaaacaattttccaggaaggacttttggagacatagtcattacaggagtaattactcatcatacttaatacatacatacatttataataggttgtacttttgcatactacaattcaaatgtgccaatttatttagcctataagagtttattttctttagtctatatgactttatcttgccccattactcctattatttaaaaaaagagaagaaaaatacatacatacatatgcatatacacatctatatgtatatgataactcagtctctactgatttaaaaatagttaatactaatcaattcaaatattctctcaaagtcaaccaaaattaatagcctctgctcagaaatcatacataaatctaaagtcttcacacttatgctgtaccttcatgaatttttgtttatgtaaatcaatattttatgccaaaaatagaatgcttcttagaaaataattgaaagaaggaaattcattgtataacagaagagtagcagttgattgagacaaagagattgttatatgcatgagttaaaatgcttaattgtgttggatcctatatcagaactaatttactctctttttaggttagcattgaggtgaatcccttgatgataaagccatgtcatcacctgttttactctaaacaaagacatttataaaaatggtaaacctgattatatttcatagtattcagaaagattcttgtgtaagattattaatttttacaatgctcctattgtcagctgaggtaaaattaattagaacaaccgtatcctaggaaaatagagtcaatgagcaaagattatcacatatttaaaggaaataagagcagatgaaagctgttcctgaggaatgaagtaaagagagtttgagacggtggaagatggaacaggaagaaaaaaataagataaaatggtgacatctcttaaaattgttttggaagggtcatttacacactatggatgaatagcaacttattcctagaaaatgcttgttgcctaggttgtgcaaattctcagttatggatagatttagttattgatcaatcatactgctttcgagaattttaatctgtttagatttcttaaaaagttcccatgtatataaacaaagtccatttacttgatggcattatattagccttaggatatttggaggacttgcatacttggagacaagggcattccagatgtcagatgttttcaggacaaccctctcacccagtgagacagattgtatgttttttccactgtgacttgctccgatttatatttccttcagcccagaaaggattattgtaatatatcaagttcatcagcattttttaaattcttacattaatctatttaagttgaggttctattttacctcaaagatatctattacctgtatttatctatccaatcgagttcttgccacatatatatacttttttaattctgcaattcctctgaagtttttaagagatctttgcttgctggttagaataatcctcaagtttttctaatcatagcacttttattttctcattcttctgattaaaattctatcctcttcatttgcaaaggtgaatatatttggaactgtcatctccaatgaatgaaaagcaattagaaaccctagaaaagatatttgaaataattattacaaaccattttataatttgttaatttttccagatttctataaaaagcaaatgcaaataggaaagaaacaagaactgggctttcatatattttccaatctgagctgacttcaagacatgaagattaactagtggtaaacaagagaaaataaatttaaaataaggaggacaaatgtagaagttatcaaagattacaattttttaaaatctcaaagcttttgttgaaagaggttcccatcaaaggaatttgtatcaaaaagaaaatgaataaagctgaaatgtaattagaatcaatgagaaaatatcagagctggaaggacattaataaatccttagtaaaaatagcattatacagatgaaaaaaagtcaggggtcaagaaacttaattgatttgtctaaggtcatgttatttgtcaatttatttccaagaccagtgtttctccaaatagagattaatgaaaagaagaaagaaaaaagaagaaaaagcagttctccacattttttttttttttctgcctggaggtcgtgattcatttggtgtggaatggagcattcacatttcctgtttccttggctaacagcagaaaactattaaatggaagaaaataagatgtgaactgaagtggcagaaaaaagtaaatgaaaaaaaaaacagaacaggagactttgtttttggcagttttttaattatacatatatctccctcagcagccacatgaggagggccggctgggtctttctccattctttgggcgagtatatttcaaaatatgtttaagagactatcacatccaaatcaccagaggggagatcgtagctagtcccaggcttttttccacgtaacttagtaaaaatctctgtgaatagttccccaaattctgcatttttaacaagctccccgcttatggagctgtctccttgagtgcaggaaggacaggctgttttactttataactgggacagcaagtacagatcctggttcgtaggaggtgcctagaaaatacatgataggtaattagttaaattgaattaataactataataagtagtaaaacttaataaatgctagtatttttttaattgtatatatctactactagatacaaactttgagtggtggtgttcatttaccaaagttttggtttttacacttttccaaaaaatgtcaattgctattctgtactctatacaatcagaaggaagtcagtttgagcacataaaaatgacataataggccgggcgcggtggctcacgcctgtaatcccagcactctgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaatgacataatattctgcagtatcaagaatacacagcttgatacttcagatttatttttatctttgaaagatattaataaaataagtaatttataaaaacaaagagattttaataactgaaacaaaaatactaattatgataagactaaacatgtaatgtagctgtaggttgaaataaacttgaaacactctagtgtctgcataccttttgctttccccaagaactatttctgcaaaatattcactagcctgcagagataacccacatagactatgttattaatatgcaatcttccttcctgaaacagtttacatatgcagtatatagcatctagaccttgtaattgaattttcaaagtttgctgtggtttgggagctgcatatgggtcagtaatcattatccagacaccatcatttatagtacacatacaattaatcaactcattaattatggaaagagtctcagggaaggctagtacacctatttcttaaacaaatatgttacccttgagctgtaaaagtagcatttccatcagccattgccttagattattgttagatatttgttctgggatcttttaaaacaaggcccataagaagagtcaatataaaaatctttcagacataaggcctgtcgtatatgttcactgaatttaatcactttctggttaactcactgttcaagtcagctttggatctttatcttctgaagctaatgtcaataacaccttatttttaatttaactaaattcagccaaacgtaggagaaacaaatcatgcttcttttcattactagttttagtagattttttgccagggcaaaattggtaattagggacagtaaagtattcttcaaatatttttttcttgttatacatttgtaagcccaggaggttgttaaatggagacactttatggatgcagaaaggaaaaaaaaatcagtaaatatatcttttcacattcttggctcattagctaaccagatgaatttcctttcctcttcgtcaatcccactcttttgctattttttccctactccgagcaatttatcttcatgttgcactgactcacattatgacctacaaaactccttgtaaaaagacacacaacagaaaaagaggctaattgtgtaagataaatgccaacctaaaataatgataaaatataatttgatttcagcttaaggaagagagaggaagggctagttatttaatagagtttttgttaaatatacggtgagcttaaggaagaggaacagctgtttgccatcttcattgaagtcagatgtagcttagacttaatatgagagacatgaagaagagatttttgtctatagatttctaatgggaattttagtcagaggaccatgcaaccatagaattttatttcttgtaagatgtagagacatacgagataatttatgacccattcaacttaaaggtaggaggaaagatcagttggtattttaagggttcctcttttccgataccacattgtcctgacttctttgagcctcagttttccatctctgagctcctttgatttgaagttataaaataccacagagttcaaggcttacacttttagctctttgggacaatgtctaggagagcatgaggaatgaccaagagtaagctgagatcctgaagttttagagtagtctcttttgtctcaaaatttaaccctttcaagtgcttttagtggaggattgtgcatgaaagagacacctgcttcttattacctagaccttgtctctatctattagatacatttctatctcaccgagttacactcccaaatactaaatttgccccagttctccctgtgccattgtttcatggccagttgtgaaattttgttctccatactgctaagaaaataaatgtacagtgtgataagtggtgttatgtaaaatgtgggagtggtagactgaagaaagcctctgggcaaggaaaacataaaaaagtcaacaaaatgcttcaagattgtttgttttaaattgttataaagaggaaacagaacataaaaatatggtatgtgaaagtaaagaatttcatggaggtttccaactacactttagttatggatatcttttttttttttagaaagaaagcttttgagctactttaacatggaccttagataagaactgaagttcaattggcaaaacagtaggaaatttgaagcttcgactatacctcagggaatgtggaaatagtttcagggaccatgcatttctgctcacataaccagttttaaaaccatagccctcaatgttacagtcaagatttgatgtagcaaaagggcataattatatttacattgatacctttaatatatagcaatatattatttcttcaaacaacataaatgtagaccattagtattccctttatgtcttttgccttaaaccagctatcatcaaaacacaatgtaatgccagtaaggccatgagaaaagaagggaagtggtattctggctgcctaattcggagcaggagggagggaactaccacctatcactccatgtatatgcagggctgattaaaccatgcaagaatttctaaaatgaataagtagctaacaacatcctgtttcttctacttaaattaatgaaaaaaagttttgagatttattttagggtttattacccttttcttcttaaaatatccatttctaccatctctggagatatactgtcttacttatcccttaagtctctgcttttattagtcaatgttcataattggaaatatctttccacctccatccctccttcaagattaaacattctatgaagaacagggctcatgattggtaaatattcatatatctatgttaacttatatgggacaacgtattagttgttaaaatatgaatgtatcataaaagacttcctgatattggaggcttcacccatgagtccagacaaagacacacctattatacaacttacagtttcacaactaatggcccatgtctaaaaatgtaaacttgaagtatatctttaataattttgtttttgaataattagttatattttcaggtgtttttggagtctgttttgttttcatcttttttattccatcaaaaagctcacagattttaggaatttggatgtgtgctataccagtctagataataaatgctgattacaatgaaaatactaggtcaagtgaaaactggaatcaagtttaaaattatttttatatctcttcatacttagccagcaaaatacccatgctagatgagattattgttcaaaattattgctgtcttcatcaaagcagctcatatattccttgctaatatcatgtaacacccactgcttctctgtgggaggaaaatacttcacaccactactgtcagggttgaggatgtgactttgttggtgcctttgtcagctagtgctgtaataagaaactactgtagactaggaggctaaaacaacattgatttctcacagttctggaggttggaagcctgggatcaaagtgcctgtagggttgttttctcccaaggcctatctccttggcttgcagatggttaccttctttttgtgtccttgcatggccttttttctgggtgcacacatccctggtgtctcttgctttcttcttagaaggacactagccctggccaggtgcagtggttgatgcctgtaatcccagcactttgggaggccgaggcgggtggatcatgaggtcaggagatcaagaccagggagaaaccgcatctctactaaaaatacaaaaaatttgccgggcgtggtggcaggtgtctgtagtcccagctgctcaggaggctgaggcaggagaatggcttgaacctgggaggtggatcttgcagtgagctgagattgcgacattgcactccagcctggggtgacagagtcagactctgtctcaaatatgaaaaaaaacaaaaaaaaaaacaaagaacactagtactattggattagggccccacctttatgaccacatttaacctaaattgcctccttaaagggctgtatcttttaatacactcaaatgggctgttgtatgcttcagcatgtgaattttggggggacaaaatttagtccataacacctgggctaatggaacgtgatttaaagtttttgcaaattctgagtaaaagatgaaagatccatttaatggttgctacagttctcttccctctgccatgaggccaccaggtactcaaacaacgctacctctttaccctgggctctggattaaacaggacattgaacagagcggtagtctacttgttagtaccatgtaagaagaaaatcaagtaaatctttttgttttcaccattatgattttgagactttcatgactcttgataccacaacttagcccagcaagagctaagtaataaagtaatcattacttataaatagaaagcttttattaaattatgtggctttggttttggagtcaggcctcaggcagcaagggatttattattaaaggttgaataaaatgcagtaacaaaccatttggtaaaactattagctgcaagtacctaaaaggcaattgattaagcaaacaggctcctggtgatgttactagcatatcactctctcccccaaccactagttagctacatttactagagctacaaaaagtgcttgctacaagaaaaagatgagctcagaaaaacactggccagtttagaagaattaaaagaaagaaagacagaaattatcggacttgcaggattaagagtaagtatttttcatatccaacttgtaaaagataaattaagaaatgttttgagtgacaagtcccattaggactcagtctttgatttagacaaaatccagagaatagctttcatatcctcgttgaaaccaactaattaagcaacatgccataattcctttcagttggacaaaagggctccatgaaaagagactaaggatggacttttacatgaaagtctgaaaatttaataaaactctatcttaatttagagataggcttgcatatgcaaaatatcatggatgtaactacaggtatgctaagatgactataagacaaacaattttaaaaattccattgcagttttagagaatggttctgccaacagggccacagtactagattcaaatggactatggcaatttaagatttaaaatgactttggaacatctaatattctacagacagaataaaggttagaaaatgtattccaatctcccttgctcccccagaaggaggacatattttctagagtcctcttcagattttttaatagaagataaaggaaaaggaataatttctcaaatgttatagtcaagagttttggagaataagagataggggaactactgctggggagcatagttagggactttgatgaaacattaagacttcttcaggtaagatttcagaatggcctggtcttctctgagcattctagtctaccttttgagaatgaaagcttgtgagtatgtgtgtataattgtatgtgtgtatgtatatgtgaatgcatgagagaaagagagactcagaatagttattataaaacactcatattttttcaaaatttcacaatatatatatactattacagtttttgcattatttgaattttacctgtgtcagtgtagactttgttaaaattattcttgaatttttctcttatttcactctctttcaattcatctctctctttctctctgtcatataacacacacacacacacacacagatggctttttgtaataaagaaggaaacacaactttgagctaagcagctaaattaataggttggctgagttgacaatgaccttcatagagaaatctaaaggagagggaaggtagcattctctgtcgaaagagtgaaacctttgtcagttattttatggtatgtcatttttttccttctttttttttttttgaatgtttgatatctatttgaccgtcagttgtaccaactgatattcacatggccttgtaaaaaaataagatttttattataactttaaatctgttaggtcctgagttcaagactcttcaggaacggaatggaggatagtatgtgagtgtagagtctaatattctcaaagaaaaacggaagacgagacagaatggggcatgttggtagacatcttcaagctcatatttttgtgtttggaggtatttataaatggaagtttctaaatcctcttgttcttgaaattgtgtatatttggaacctacttttcagtttctcatcctcaaaaattactttaaatttaagaggacacatttataattaccttataaatcaaaatctaaaattttctttttatatgttaaatatttatttgttgtttacttatttatgttgacaccatagtgatgtttaatttattatgcttctgaagtagcttcttagtacatgatgggatatatttaatactgcagaacatttctgtactagacatcacactgcctaagttctgcttatgggcaatatcaaacagtctactcctctacaatgaggagactaatgggaattcaaagagtaaaaaagacattacatcccagttccttcttacactaagctcatctgagaatcattcttcagctacctattgagcaagttgtttattgttaggggcctctgtggaagaggaaaggagtcactgtaattgaaggtgtttatctgggaaggttctgggaatttgagaaagacgagatccaagcactgagccagtgggaatggaattcagtgattggaaggcagcataatgggaaataagatataatgaaggagacaaagccaacagaagtaggaacatggaacaagctttaaacaattgctaggagaaagcaaactaggccattgtatcaatgtgcctatgcaatattattgtagcttgcaaaattacaaaaagtaagaacctccttcagagagctagcacagggacattaagttttaagtagcagaatcaaattcaataagacaaaaatagaaactgcattttatcttacaattaatttcaaaattaaatcaggcatctatgctatcgggttgactatatatcacatacttaaactcaaattaataaatattttttgatagcttgctatatacatgtaataaattatagtaaataaatgagagtaagactcagattttcagaaaattacacttcaacttacggggacataaatcaatgtttggataactgaaaaaacaaggtatgccaagttccatattaggcatacaaagagataattaaagggatgcagtggaggaaaacaacttatctagtaggaacacaaaagtttttttaaaatatgatatttgcttggaaataaaaaaagaaaaacctatatagtaaaaagaaaaatggtggatatacattctatgcaggaaaaaatacgtaaaaaagttcaagaattaaaatagtgaatatattctaatttgtcaaaataattatacatatatgcatatataattatatattttccgtatatatacatatacacactatatatacagtatatagatacactatatatacagtttatatagatacactatttatacagtatagatacactatgtatacagatatatatacactatatatatgcacactatatatatacacatatatatacacacacacacacacacacacacatatatatatactcatgtagttgggactcctccaactcatatagttgggactatatatgtataaatatagtgtgtgtgtgtgtgtgtgtgtgtgtgtgtataaatggcaaaggactgataaaatgattgagatttatagcatttttcccctcattacccaattctaaactaataataaagtctactctcataaacccataaaataatttgggaaaataaaaattcactcttctcattgcagtgattacatatttattcttttatttctttaaccatgaaaaaaacattttgtacttttcacgtaacagaaaatgtatataaactactggcataaacaaagtaaagttcccatttttacaaagttcatattgtaatgagaaaatagagtaactgatgaagagaatacacctacttgacaaatgataaagtctttccaaggaaataacatttaaatggaaaacttaatgtaatgaatcaagtacaggaagagccaacaaaagaatttttcagaatttgggaagaaatacagagttgttagtgtgagaaaatacgctatggcaagtcacaagaaacaataactatgatattccaactcttcacatcaagtggtggagtcagtttcccctctacttgaacatggactgactttgtgactttcgttagcaaaaagaatatggtggaagtgacctatgtgccagttataagatgaggccttgacattgcaactcttgtagttgggactcctgctatttccatcagaacaagtccaagctagcctgttggaagataaaacattatacagaacttagtttatttatctcatttgtccaagccatggacccaaaacttatatgagaaagcccagccaagaagagccaaagtgaaatgcatctgatctgttagatgaccacggttgcatgatcaagtccagccaagatcaatctagcttgatcaagatcaaaagaactgcagacccaacatatagaatcttgtagcaacaaggaattattattttaagtgactaaattttaaggagggttgttaatcagcaatagataattgatacaatcttaagcaataatagattttttactttacattataagaaatttcaaattggctcaccctgcataccagtatcaccaaggacccagatgttctgtcagcttcagcatatttttgcttgttttttcatttgtttttattttttctctttacactgacagtgtttcttacaagatgactgatacatttcaaagcaccatttcttgttataacggcactcaaggtaggaagaaaagatacttcgatttctcatttctctttttttcttcaggaaaacaaaatcttacccagaagtcgctcagcacacttctggctaaaattgaatcatttacccactgaaacccatcatatataaaataaattgatatgaaattgaccaagttttaatgttatgatttactccataggcatgctgtcactcaaacaaattaatcacctaaacattaaagaagatggtaaaattgatagaaaaacaaaacactaacacattaaaaatatttaaatgctaattactctgaagtctgcatacaagttaagatgcacgttggagaagagggcaggatccattcatacaaagaaccgtaataaagatattggaaatatctttcttatttaaatatatttaaataagtgaggaaaaattatagcagcaattaaggagagtgatgaatggattataagtgagaaaaagaagaggagaatcagagaaagaaaggaaactaattaggagactacgttcctaagtccaagtgagagaatatgactagtgtgacatagattaagaaagctataaatagctaaaagtgtatggatttgtaatgagttttagaagcaggcttgctaatgaagcactttctgtcagggaaacataccactcaggatttattccactgtttgtgtcactggagttcttggttttgccatttcctaaaactgactgttactggggcaaggtttgagagagggaaggagtgtactgagaacgttaaatgtaaaacacccattagacatttaagtggagctgttcagaaagcaacttgatacatgaacctatatcaactgaggatttagtactggaaatactgattgagggttcagtatattgacagtatttgaagtaatgggtaagaatcaagttacataggagaaagtagacaaagattgcatctactagcattacttctccaaactcatctctcattccctaaaattgtacagttgtacaatatacagcctcaaatttcatatgttaaatagaatcctaaagtaaaacacgtgttcaaaggttaacatgctgcccactttcaaattttattgatttactgctattttataaaatgccttagagggtgtaagagttactacagcttttgttttttttgaggcagagtcttgttctgttgtccatgctggagtgcagtggtgcaatctcagcttactgcaacctccacctcctgggttcaagcgattctcttgcctcagcctcccgagtagctgggactacaggtgcctgcaaccatgcccggaaaatttttgtatttttagtagacaccatattggccaggctggtcttggacttctgaccttataatccaccctcttccacctcccaaagtgccgagattacaagtgtgagccactgtgcctggcccctaaaacttttaaataactgctgtgatttgcttcttgggagcatttagctcagtaagtaccagatcaacccaccaacttgtgatattgtttaatacatgtgaatatcaccattccggggaaatcttacagtatcaggctttgcaagggaataattagatgtgtcttaggagcttttattttactttatttcatatatatggtgacttaaagcagggtaacaatatgctgtgatagcacactggtatcaaaattttaaaaaacaatctatgtttgcagaactaagaccagttcaattttgcaagcatctggggtaagtccactctatttctatgaaacccaaatttcatagaaatgttcacagaaattgggttcctatgaaacccaaatttaaactttgtttacttacaactctgtgaatacataattcctcccatcttcattgctctcagatttataactgcttcatgtaattttccttagattaatttatgtagaattatttaaaaactaaaaacacaatttataatgaaagtgcgtattagttgaagttatattcattatttttgatacaaagtcacttaaaaattaatagcacacatatgatcccacaattccacttccaaatatatatttaaaaaaattaaaagcatggactcaaatggaaatttttacaccaatgttcatagcagtattattcaaaacagccaaaaggtggaagctatccaaatgtccgtcaacagataaatggataaaataaatagtttgcacatttctgatttacttttcttagattataataacttaattttaaatatctgcagagcaaaaaggcacagagattgaaaaatacattttggaaatattgcctttaaaggaatttctactattcaaattaaatataatgccaaaataatatttgttaaagcttaaccagggactaatttacaacataagcttagcttggaaaacaaacaaaaacagaccttgttctaaaatgaaaaccgactatttgacttaaaatttggaattttgagcaaataactttgttttagaattacatttagctattatttaccattgggcaaattcatgactattcatgaagtaaattagtttccctgcaccattcacagggcctgcaacacagtaaggattcaataattgtttcttgtttaaatgaaaaaaaaaataatgagtttataatatctagttactttttatttttaaattaacaaacttagttttttgaactgctgcaggcttatagaagaattgagtgcaaagttcagaaaattcccatatatctaccccactaacatatggtatatttgttcaaattgatgagaaaatattgaaatattaactaaaatccttggtatatatttggtttcccctttctggttgtatattttgtgggttttgaaaaatgtataatggcatgtatttactatatttatctatatacatgccattatacatttgcacagaatagtttgactgccaatcagtggttaccaaggacataggaggggaggaagagggatcaataggtggaatacagggattcacggtattcactatcttctagtttggccttttccagaatatcatggagttggaatcacagagtatgtaacctttgtcagattggcttcttaacttagcaagatgcattttttggacaaatcaggttgtcataacaaaaatggcataaactggatagcttaaaccatagaaatgtgtttcacacagttctggaggctgagaagtttaagatcaaaggctgacaaggtaaaatggccccttctctttgcttctcagtagccgttatcttgctggtgtgctcaaatgacctcttacttgtgcatgcatgggaaaagagagcttctgtgatatctcttctaataaggacaccaattcttttgaattagggctctacacttatgacctatttaactttaattgcctcctaaggactttatttccaaatgcagtcaaattgagtattagagattcaatctatgaattgtggagacaaaccagtatatgatatttaactcttggtctcccaaaattcatattcttttcacatgcaaagcatattcaccttttccaacagtcttccacatcctaattcattctagcatcagctctaaagtgtaaagtctcatctaaatatcatctaaatcaggtatgagtgggaccttaggtatgattcatcatgaaacaacatttctctaaagctgctgacctgtgaaactagaaaagttatgtggttccaaaataccacctaactttcatagtatgatgggacaggcataggataaacattctcattccaaaaaggagaaatatgaaaggagtagcagctcccaagcaagtccaaaaacaggcaaagcaaatttcattagatcttaaggttcaataataattccctctggctcaatgactcatcttctggactgattggggtggtgactctgcccccaaggccctaaatggggttgttgccaggctcaggtcttcctcccaaggccctgctggcagaggccatctggccagttgaaactaagccggtgaccctgataattctgaattgcctacagtgttatttttcccttgtcttgaaaaacagtgtatgtttgcagccaaataactctgttgtcctgtcctgtagaatccgagaagaccctcaggcttccttcactttatcttatctccatccccgtcagttcaaactggcagtgtttctgcctgtattattccataatctctttatcaagtgacagtctggctatacctttggtattctcttagaacatgctcttctcatttttttgcaacacactcaggttgagaattctctacatctttctacatttgattgtttttcccttaacaataccttcctcaattaatctctcttctaacatttaactataagcagttaggagtattcaggccacaccatcacattttgctttgaaatctcctcaactacctatctaatttcattgttcacaattttgattttttgcaaaacactagaacacattttagtcaagttctttgccactttataacaaggattaccttttctccaattttcaataatctgttcctatttttgtctgagacatcaccagaataacctttaatatcatgtttataccaaaattatattcatgattgtatatgctttcattaagaagttggaggctttctctctatctccttttctttctgagccctcatcagagtcaccattcatagccaatgtccatcaacagtccctccttggcaatgtggatttttttctagcatgcacctcaaaactcttactgccctctcttattacccagtgccaaaactgcttccacattttaagtgcctcttacagcagcattcccttctctgtaccaagatccattttgttgaactcagtcatgttgggagttaggacgtcaacatatgaattggggaatgtgggcatgattcagtccatagtacatttcaaatgccagattaatagaaagcatgaggaagttgtaatttgttattccagagtctgcacaaacagctgtcaccatgcttggaggccatttgttagattggtagcgtatgggccgccattgttccttgcggcaggcagagtgagttgatggtggtgtgctctcctttggatctccaattggttgtcatagccatccttcacaaccactcccaaattagtaaagatgaacctggaggagcatttgctatccctggtgtacagaagcagaaaagaacgaatgtaccagcagttttatcagtagtcaccatagagtatcaccctaaaatgagatacgagaatgttgaaaatgacactcctctgacatatggaacgatgatatagttatagagctgccatagtgacctatacttgagaaaagcctgacttccaaactctatatttagtaattccttaagaagacaggctcaggtattttttcaagtgaagcagaatcccacatctactccagggaatccaacatcctaaccagagctggaatgatgtcaaaatataactttctcctttcatgagcaaaactctttatgtgtattttaattaatattatattttctgcaaattcttacttcatggcacaagaaagtcaaatcagataaactgaacataattttacagctgtggcagaattgttttgccatttctgtgagatgtattccttctaagcatagtatatagacgtataattctgattatattattactttgtatctttccctagcaaaaattaattaatttctaatagattggggtatggctttcacctagtataagaaattcaaataataaccaaacagggaatagtttccaaatgagtatatgaaaatttaataatatgtgaatttaaatattcttttatatatatagattaagtattgtttcaataatttatcagtcatttaagtagatgctactgtaaagcaggccatttcaaatcgtataatatttaaaatccataataagcataccaagcacatgttatattaattttatagacagtaaaactaataatcaggcatattatgtctttacaaaaggttttacagacttcaaaaataattataccaggatctgaatctagaactttttggttattggtgtgtctgtatttcttttcttatgcctctaaaaatgtatagtgtcaggtaaaaattaataatacaaaaatagttatttttggtatttagcaaaatttttataaattacttccttgagaaagggaataaagagtaattgtaacacaattttacaaaatctctaattgccacatagcagttacttacattttatgatgctgaataagcaaaaatttattttttgagatccacaagattgtcttcctataatttctaatcatgtggacttaggtgaaaatctctgtggtataaggctccagtgtggctcctgtaatccctaccttctcgcgataacacctttgtgctcttaagtgtgggcaggaactgagttacctctaacagtagcaaatggcaaatatgagaccatgtgattatgtgaacatgattacattacatgagattgtaactggtcttgctgggagactctctgtcattggctttgaagaaataaattgtcgtgttgtgctgttacatggagaggatcacagcttacagagctgagtgtggccatcagctaacagctagcaggaagctgaggccctcagggtaatagccttccaggtacttgatgaatactgtaaggaaccatatggatgtggaagaggattcttccccagctgagattcaggtaagaccatagtcttggctgctaccttgattgcagccttgtaagactctgaagcagaagagtcagctaaatcccattccaaattcctaaccaacacaaaccataaaataattcacttgctttgtttaatctgcacatttcatagtaataatgctgtgtgtcagtagagacacaatattatttcttacatttataccttatcatgctttatcactggctatttatactatcacttccagaaattttaataagaaataatttacatatacacatacacaatcatatatatgtcttcacatgcccaaacacacagcgtatgtgcatatacagttgtttgactcagagagaggtgtatctgacacttaaaatatttatttctaaaatatgcatttcaaaatatatggctgggctaattttgtctttaagtatctgcccttggaaaatgaactgaattttcataagtaatgagaaacctgggtgaagctctcctagaagattggccaaaaagtgtaaggcctgaggcattgccaattactagcttccagaaaataccagatgtagaggtcaccatttttattacaaactatgaaaataaaacatgttttaaaattttttttgtgcgatgaaaggccaaaagctgaagtatgtgtttgccatggaaatagtgttttgtttacaggacttgtcttttctagaactcatccattaaatggtaggagagaaccacttcaatcttgacattgtattgcattcggagctttcattactagaataatatttgttcatttttcaataagaagcataaaatgttccattgctcattttgtccgtttgtttaatgacattggtaggcttgttacttaaattaaatccatctaaagaaaatgaatatgtactggttaatccaactgaacccatgtaaatacactactgtggctctaaacattggcaaatataacaaaccctcactaccatacaggatggaatgttacagataatgttctgcttcacaaccaatgacgatggtgccagaatgctcatgttcttgtttttcctactttctgataatttgtactaattaagataggactggcattgcagatgtagcaaccaaacattttatttcttcctttcacaaaatcactctagtccgggtgagttttgggggatttggctgctacacaggaattcattgagtttgcttttgtcttccggttccacagtctcaacacaaagtctcctcattgccctggcagaggaacagaatactggagggttttctactgacccaaagggacacacatgatttctactcacagctgtttggctacagcttgtttcttggtcctggttaattggaggagggctaggagaataggaaagtgcaggttgcatttgtcaagtgttgttaatcctctcacatctatcatccaggtaaaatttttcactgatctgtacccacaaaccagggggagtttttttttaaccaccgacaagcctgttcctttggtctgttgcacttttgaatcttttggttctcttttctttttttttttgtattccctgacatgaaataaaattatacattttatccttgcgatagtttgctgagaatgatggcttccagcttcatccatgtccctacaaaggacatgaactcatcgttttttatggctgcatggtatggggggaggggtagggatagcattaggagatatacctaatgctgaatgatgagttaatgggtgcagcacaccaacatgacacatgtatacatttgtaacaaacctgcacgttgtgcacatgtaccctaaaacttaaagtataataatacaattaaaaaaattatacattttataactttgtcaaattctacatgctatttccttgcttgagcttagatttctcttttttgacctaacaagcccgtaccattttaaaattcagtgtttcagtgctacttaaaaatagaaatgctccttttatccgccagtcccttgctgtcataatactatatgttaagtgaagatttattatataatttatcagattgaatatttctcatgtacattccatatctgtgtgtgtgtgtgtgtgtgtgtgtgtgtgtgtgtctgtctgcctcattctttaaccttgccctactataaagaataaggaatgtgagtacccatgttacaactacctgtgcttcaaaaagaatgtaggttacagtatttacacagttaattgttgaaatagctaaagaggttagcatcatgcttatgcatatttaagtgctcaatacatagtacctttcatgaccatacaaaataatatttggaatatatgattacttacagtgtacagacttggtatattacttctgtaactttttacttattcatagggactgttaaatcatataattcatttgattagatagcattcacaacattagaaaattaaacataaccactacaatattctacacttttgattacttgtttttgattctttgtctcctaggcaagagaaatagtatcaacagaggaatggaattataactagaaattttattttggtgaataagctgaggacttcctagagaagctgtatgatgtgaaatagttgcaaataatgacaaagtaactcgtagataagttactttaaggctttatttgttaagttactgcatagagttgcaaaagcatcgacaacatatttcctcaaaatgtagagtttacaagttttctgagctccctgaagtttgcaatctattccagtctcagtgtcctctaattttacatcaatcttctaatgatctagattgcccattgcatgcagctatcttttcatgtttgatttggttaaaggaaaatcagctttacattgtgaaaatgcatattgttagcgaattgtgaaattgtgaggaattgggctgtaattactgaatattggctctccatgaacatgttgctaaaatgtgggaagatgtgccagagaaattgtctctctcctcagtagtccatcgttacagcaacaattgtggaaatcagatgagatgtggaaccatttttgattgccttaaatggcgcatttgtatatgccagcaagaatctatgcttctatgtaaattgaaaaagggaaatgaaacagtctgtggatgtggactctctcaggttgaacgtaggtggatcagcttgtactcaacatctgttcaggctggaaatgcagaggaagtttaatatgtttactcaatcatactggtttcctgggtgccaaggcagaaaatctaaaacatatgacttctgttcacactatgtgggagctatttagaacaaaggtgatgatcctggaagaaaatgtggagacgctatctcgggtaccagcacagttggacttctttgctgccagcaatcaacagcccttaaacatcaacatttcaaggttttgtcgaccagtgtaccaagtaacctctaaaaacatttgagaagaaatagaaaataacactagattatttcttaacatatcaaaagattatcaacatatggccttggatgcttttcattccccatccttatatgtccatacaaaattataatacatttaatgtagcattccaatccagatagtagtttgtggagttaaatttcaaactccctttttgaaaatttccttgcattcataaacacgttagctatccaggacagcgtgttgctctaggaacaaaagtggggacttacaaagaaggcaaattataagaaatatatttctgtcaaaattttatgaaacaaggaaaatcataaaataaaaattaatattagaagaaagtcttatcaaattctatataatgatttttcatcaatatacttggcctctaattagttaaaaggaagatcatgcaaagcccagagtttttatcttgtggttactattcaatttaaattctcatattccccaaaatgtccttgttttagttggtaagacagcaagacagtagctacaattcagtggaattaagtactttgccatattccatgaaatacacaaggagaggtcagaagaaacacaattatttttgtctggcagaatacaaaaaggtgtcacagagttggcatttgaattggattttggaagatgaatggaaatgcactagctggagatgaaaagaacataatggactgaggaaagttcctttccaaaaatcaagaaagctgtaaaaggcacggggattttaataattatcttcagttggaattacatgtatgttgagtgcagggacaaaattgaaaaaatagttatgcctgaaaagttatatgggaaattattatcaaaggctattgatgtcaagctaagaagattacattttacctaaaacacctaggatctttaaagtggatgtaagactagttcctcttccccattcttatgttttccatattgtcctcctccttgtgaaaaattccaccaccgttgtcaacacttcactttatataccatactaatataatactttcacccatgagcagaatggatgagaacattctcagaaataaattaaaattactacatatattgtgtttgaaatggaaaaccatgaatagatacctttatagtaataaattaaatcttaacaggtgacttgcagagaacatggtaggtggtacaaaagtagcaaagtggggtggggaagtttgtaatttctaagcaattctctaaatatatttatttagtaatcatctagttctggtagagtgacttaactgagcgatgcatttcagaaacatggcttacagaaatcagatatttaggatagttataaataaaatacaacacaaagataaggcatcattatatatacacacaggagcttcataattacaattatatttgtaaaagtataatgtttaattatttaattgactaataaaattacaataaacaaaaatgactgactttaaagatatgacttgtataagcaggcttgtagttacctacttaatattacataaatttatttaacaagtaaatagacaaaagttacaatatgaattttaatatatatattatatatgtctatccactttgaaagtatgtgaatatgtttaacttaaataaataagaggataaagaaaaatcggtctatcagataaaaaaattaatgatagaaaaataagaaatccataaatgatattaaagcttcccttctctgttgttgcatgttatgaatggttctcatatttactgaagaactaaggtaaagtactggttttgtaagggtgggacatactgaccataaagcttaagattaaaatcaagtgtcatcctgcacaaggatgacacacaaatctgtgaagtgttgcatatttcttgcagtccccaaaaggacatttgactaattagctccaaggaaatggtgtgagtcaaagcaaaatgggtgacacccagtattgcacttgtgattttcatacacaaaatatttatgtaaggtgatctatgaaaagaggtgtggtaacacataggatcttgtgtgcaatatgttgttagtaggcctctcagaaatgagaacataccaacttgcatcttgtttgtggaacttacaaaaaataaaggtagagttttgtcttccacagcagctggaaatgaacatcgtgacttaagcatcattctaacaaagatttgttgattcaggtttaaggaggtagataaagagtagtagtagtccacgccagatgctgagatctgttagttttgtgcccttggtgtgattgatgaggtcagtaatagaggatgatcaggttatgcaatgtaatgaattaatatatttataaataaatttcattacaaattataaaatagcttagatgtcttgaattacaagccacaaagaatagaacatctaataaccaaaagtaggaattaataacagaaaactgcaacatttcaacattacaacctatgaagaaacacttttaagaaaaaataaatttattttttgtagagacagggtctccctgtgttgcccaggctggtcttgaacttctgggctcaagcgatcaccctgtctcagcatcctaaagtgcttgcatcacaggcatgagccactgcaccaggccaacacgttgggttttattgggaattttaaaatagtttcagcaataagattcaagaataaattatttcattgcttcaccatttctttgagcattttaaaaatgttatcttgttaaatctttgtaataacctagtgaaataagtctctaaaatcctcatttttagaagacattgaacctaagagaagcaacttgttcaagaaaaaatacctgttggtaactgcgctaggactttttatgagttagggacattttccattaagccaagctaactctagttaatttactgagtgatactgccctcaattcatgagtatttcatcttactttatttattatttaattagaagcttaataagttcatagagcttacaaacttaaagtctatgaaataagtaatgttctgatgttagctctgatattgtctgaaatactctaagaacttaataaatttggtaaatgttttctatatccgtgttaaaatagtaattttatttattacatttttatacatagcattcatcaacaacttttgaaacatatacgaaaattatctaaaaatcctcaaaataccaattcaggtaagacttcagatagcaaactactcttgatcgtgctaccataagattatggaagcgctgatcacaaaaaagcaattcaaaaagcaatgtgtaaatagcatgtgtttccatatatacgtatgtgggtgtgtgtatatatatgtatatatagctttaatttttttagtttattattcagaattagttaagaatttagttgtaggtagtttataatctcaaaaaaattatctgaaaaaatatttaattatggtccctaaaatcctatataatacctttgtgtatataagtaacacaatttttaagtttgtatattgtatgattcctcaagtgtcataacaactgagacttgttataaaatgtataaaccttggtgtgattgatgagctcagtaatgtgggatgatgaggttatccaatttaatgaattaatatatttataaatagatttgattacaaattaaaattagtttacatgccctgaattacaagccacaaagaattgaacatctaataacaaaaagtaggaattaataacagaaaactgtaacatttgaatattataacctgcgggggtctatcctgcagaccccggctgcatgacggatgagacacatacccagacagcgatattcagtgaaagagcagcaagggttccgagccgattacagacaccaaggttcttacaataaagtgagctggaggaaagaacctgttataaggaggaaaaaatatactcactatttattaagtggaagtcaattattatacatagaggtcttcattcttattgccttcatgttgagtagtctgataaggagaaggcagaggagagatttgtcttgctatcttgcagtggcaaaggaaaagaaaaatctattagtgggctcctagagtgaaaacccttattcaaggatcaactgtgtcacatagtgacttgtgtcactaaaaaagtaactatctttagaatttggaatttaataatacttttctggcaccataaacaaatgtcagcaagaattacaaaacttagccagggtgcatcagtaccaataggagaatatctttcaaagatacctactgagtgcagaagtcagaaaagcaattctttgttgagaagcgcaggttatgttacatagtcttgtaccaacaaggtctcactattatcaacttcattccgtctaagttgaaaccaaataagatatgtttactccattagagcaaggtatgttgttctatctactggataattagtgtgttaatagtaattttgttacagcaagatactctgtttctaatagccaaaatattatcattataaatattcagatagcttaactctaaactcaaaaaaattataaaaatattacaaaaacttttcacaacaatgaaaatgctactgatacctaaatgtgacacattgtacaatatgaactgtatgagcacatctttattatatatttaacaaaggacctctataagttaggtttggcaagttgcaggagacaaagatggaatacacagtttgggtctttaaggtgctcataatacagaagagctgtgcctattgaatttctgcatttttccaacagaatttccttaaaaagtttgttattcatttatccacttgtccacttaacaaataactgtcaggtatctttaaggtactaagcatcttccttgttattatcattgtcatttttatttgcttctttattaagatactaaacatttttcttgttattattatcttttttattatttattatttatttagtgtttactctgtgccggaaccccttttggagcttataattattacttattatgtcatgttgttaccatattcagcatgtgtcagaaattttatatccaaggtgaagaattaaagctttaaaatgtttggtagtgtccaggcacagtggctcactcctgtaatcctagcagtttgggaggccaaggcagatggattgcttgagctcaggagtttgagactagcctgactaacatggtgaaactcgtctctactaaatacgaaaaatcagccggttgatgtggcccgtgcctgtaatcacagctacttgggaggctgaggtaggagagttgcttgaggtaggagaatcgcttgaattgcattgagctgagatcgcgccactgcactctagcctgggtaacaaagcaagactccatcaaaaaaagaaaaagagaaaagagaaaagaaaagtttggtaatatttaaggaaagcatacagaataagtagaagtttgccaggtgaagaatcaggaggatgatatttaagcagaaagaaaatttaaccagattgtgtgtttggcagaaggaacatctacaggaacacctgacgaggctgcacccttggcaggaagaacacctgacacggctgaaagcttggtggaaaaaacacctgatgaggctgcacccttagtggagggaacatctgacaaaattcaatgtctggggaaagcaacatctggaaagtttgaacagtcagcagaagaatatgttaggccatgtgtctctataacagctattgaactctgcattgtacagtgaaagcagtcatagataatgtgtgagcaaataggcatgattgcactccaataaaactttgtataaaaaaccatttggtaagctgaatttggcctgtgatatatagtttcctggcccttcacacagaagatagatggagtgtaattacataaaaagttttaaagacaaagtaagcttttgtagtagttcatgctgtagtcttttttttttttgtcaccaatctgtggcctagtatcaatctattatgaaaatctgacccatccagggtaaaatgaatcaagttcagaagctcaatttacagatttaaacctgtaggtctttctttgccattattttattttgatttgtttaactgaattttttttaacttaaaaaataacaatagtatttggtagggtttctttttcatggtgaaagccatcagttaaggggccatgtctaagtaggaaatataaatataacataataataataataaaataataataaaaatggccttcagtttcatatattattggatatattttcctccagaattggcatttcagctgaagataatgtgtgcttcaaacttggaaataaataatgcatttaattatttgattaaagattgcacagtgaatttaatgaagacattatagtcttgtaatgtaatataaactcaatcttctactcacaaacaactttaagacagaatttaggaggaatgtcctttggaaaattatctttccttcccccacagatgaatcaaataaccaaacgtactgtttggaacatttcattttatctggaattaaccctctgttggcatgtcttcttcatcactgaaaatgtaagaaagcacagcctcatcatgaaaatgctgggtatccacgtctcacacaacttaaaaatcataatgagttgcaggttttattgtcaagaattaccctgtgcttcaaaaatgtgcttgctccttatgaagcaatataaaccttgtttttaatcttgcaaactgtatattctattggatatgtctattaaagatagagttatgagtgaacaataaatgtctttcctgagaaaggtgtattttctgttgcacttagacctgaaggtggtgtagaagatacttggccaaaactggggcaaagaggggttcctgtgaagaagcaacagtgagagtctggttatctacatataaaagaataaaactggacccttagactgtacacaaaaacaactcaaggtggattaaaggcctacgtgtaagacctgaaactataaaactcccagaagaaaacacagagaaaacaactccttgatatgggccttgacaatggttttttggctattggctatcacaccaaaagctcaggcaacaaaagcaaacaagtgagactgcatcaaactaaaaagcttctgcacagcaaacactcaacaaaatgaaaaggcagcctgcagaatgggagagaatatttacaaaccatatatcagataggggttgatatgtgaaatgaaaatctcacacaactcagtcaaaaaacaatccgactgataaatggccaaagtatctgaatagacattatttaaaaaagacatacgaagggcaacaagtatatgaaaaggtgttcaacatcattaatcagaaaaatgttaatcaaaacaactatatcacttcgcaactgttaggatggttattatataaaaaagagataagtgtgatgagggtgtggaaaaaggaaactcatgttcactgttggtgggaaagtaaactgatacagccattttgggaaatggtatgaaggttcctcaaaaatttaaaatggagctactgtatgactccacaatcctcctgctgggtatatacccaaaggaactgaaatcagtatatgaaagctatatctgtattcccatgtttattgcggtataaataaccaatagccaagctatgaaaacaattggataaagaaattatgatatatagttataacatattatatatcatattataatcttatatactctgtaataatataaatattatgaatatagtattcaatcttagaaaaattaaaattgccatttttgatgatatggatgaacctggatggcattatgctaagtgaaataaaccagacatggaaagaaaaatacttcatgatctcacttatatgtgctatctaaaaacaagccaagtatatagaaacagtagaatggtggccatcagggataaggattaagaggaaatgaaaaaaagcagatcaaagggtacaaactggcagtcatgtaggatgagtaagttgtacctaacgtatagtatgataccaatagttaataataatgtattctatactgaaaattttctaaaagcatattttcaggtgctcttgccaatcacataaaaatataactatgaaaggtgatggatatgttaattggcttgattatagtaataatttcatggcatatatgtatgccttaaatatgtacaataaataagtaaataaactaaaatgtaggttatcaaaacttaacaatttaaacattaaaactttcaaaacttgaaaaaatccaatgggagagatttacaattccttcaacactatcagagcagcaatgatggaagatatgtagaggaaggagacaacctgataaatgtagactcatcagcaaagcctgaggggacagtaattatatccatagtgttgacagccaaaccatcaaaaactttggtgtaaatatattatttttgcaacatatgaaacacaaacagaacagcaaatcttgattcaggcatctatcgtcctaattaactgcctctctgatcatgtgtgctctctgatcatgtgtgcatgtgtcaccttgatcgaaaccattttcaaaaataacgcaacaaaaataaactattgtaaattttaaaaatgaattatcacgtgaagtttatatttgaagttatttttcaagattatacttatcctgtggcctttaaattttttaaaaatttttcactctctagttgaatatttgctgtatgccaggaaaacttctggacactgaagatacttacagtcaacattacttcaaggcagttatggcatcctaattactgtttttagtaatataatatctgcttccaaatactcttagaaatgggcaacttgataaggtgattcctgaaagtctctgccatcttgattgtgttaactgtgtttatttaaagaggctaaaaatgagggtggtttttaatgcatggtaactattcattaaaaatgaaattatatatgaaaaatgaaattatatatgaaattataatgaaaaattcaagattactccatgccttctaacagtattatttctacttgggtactgttgacatcagaacaaattattgggataaataaatgtgtaagggccatacatacctactaaatctgagtgccatgaatttgtaattttatgttattttaattattgtagttattacagtatgtgtttataaccctttttgtgttaatatacagtaatcctagagacacctagaattattttaaaaggtgagtcagttgtcttcagttatagaaaattgacttatacacttttagtagcgaagtcaaaatatctgaactaagttcacttctgcacaaaggaaaactctgcgagtaactgaaattttctcaagattggcatatagacaatcctaaaaaatgtcctgggatatgaactatctcaaattggcagcatatactggcatgtgcctcatcctgctgacagtcatttcagtttgatacacttacaaaaaagagaaaaaagatagcttaataattccaagtttaaatagttatattggtatactccttaaaagaaaaatcagcacattatcttggagtaaaattttacttatgatttcttcacttttctcccatcaactcaacaggcagaaaataaaacatattaataaatacacatgcacacacacacacattgtggaaatcaaagacctgagtctatgtgtagcagtgtgttgataaactatctgtagagactggaggtcaaattaattgtatatatgaaaattatataactctagagactcaagaagacagataaaagttactacataagaaaatagagatttctctatttttccacaacagaaattaaagagtggaatagtgattttaaatacagcttctgttatcatttgagggaatagaaaagtgagggcaacagagatcggaatataggcactaatacttgaatgcctgttatgtgtagctattgtgctttgacaattttacataattgtcttatttaaccaacacaaaactttatgaaattgatgtttctaagactatttttctgtatgagaaaacccaggttctgacttgatgtcactcatgccatattgggtggctgaggcaggattcaaatgtaaacacggcagcaccacagtctatattttattaatcatacaaccactatatccacctaattataaagtctgtatgaaagcccagaaaaataggccagcattaaattgaaaaaagcattaaagagaaaactgttgatctaaaaacatttagttttacaacttttaatttaccaaaattgtggttgctactgtgactgttgtatagggaaaccatgcacaaattaattcatgacacattcatgttctttttgcatacgtctcttttaaaaaaaaagttatttaggtaaagtgctaaagagaagttatttcaccttgctgacattgtgtcttacagttttacccaaccaattttagtcattacttctttatcttaacaggattacttaattgcctagtcatggaatgaatgatttggctacttctatagatgcattaataaagccttatttgtataatagtcaagttaagatgaacatgcttgtgacctctcgcagaaataatgaagattctgcaatttaaagagcaataaaatgtaaagatgtaattaccaactcttcattatcttacggaatttcaagataaaatcactttatttcaatgtcaaaagacagagcattaaagtctttttcaaataccatttaattggatagattaagatactttaatatattaatttctttccttgttactgtatatttcacgataagaatgcagggatatatattagacttctgggaaattgaaactggtgtaacttaccagttaattctaaaatctattaatcatgtgctttgcttatctttcttccttggtaaaatatgaatgttcaaagatattttcatgttgtctaaagcatccgcatttcatatacaaatatatgaaatatataaaatattaacagaattataccaaatatatacaaaataaaaatatacaaaatattaatttagcagaaaaaaaaactgttgcatgaagataaggtacaggatggtactttatcttatggttttttgtgaaccatagtcagaaaaatcgggatcaaaaataataaaacaaaatatacccattgccttaaggaaataggtaaatgagataattatatttttaaaggaactatataaaagctttatgcaaaaatcacaaccatatttcttgttcctgcacatcccaatcaattcattagattgttttacacattctgcaaaaatattctaatgcaggcagagaatttgaaatgtaaaacattatcatactgtctcctatatttagagctcagctatgtctcttatatgttaaaatgctacttctgtttgacacacactcttacacctactgaggaaaaaaattgcttcatattaacaaagtgaattatctcttttgagtaacatgagtaacctggtcaatagttacttaccgtgtgttagttatgggctgaactgtgctcctctctcccaaaattcatatggtgaaattctaaagcctagtatttctgaaagtaaccatattgggatgttttaaataagaattcatttaaaatgaggccctcggggtgggtcctaatccaaaaaaatggtgtccatataaaataaaatttagaaaggggtaaaaatcagctacatgtatgcacagaagtacaactgtgtgaagatagagctgtgagaaggcaaccatctataagccaagaagagaggcctagaacagatccttccatcatggtcctcagaggagcactttgaccttggatttacagcctctagaactgtgggaaaataaatatcggttgtttaagccacccagtctgtgtgtgtgtgcatgtgtttaagtgccaccttagaaaactaatataattgacaaaagacataatggactttttaaagccagcacccaactacgttagcatcattttcagatgtttgttttagtttgtttattttattttatcaagtattataatgataattaaaaaaaaaaagttacatgaggtggttcacacttttaatcccagcactttgggaggcaaaggtgggaggatcacttgaggctggaagttcaagaccagccagagcaacataatgaaagccaatgtctacaaatttttttctttaataaaaaataaagctgggtgtttttataataatgtgttttattataaagcacacacctgtagttctagctacttgggagctgagttgggaggactgcttgagcccaggagatcaagactacagtgagccataattgcaccactgcactccaccctgggtgacagagtgagaccctgtctgtaaaaaataaataaataaataaaaatagataaaaacaatttcaaaacttaagactaaagaaactcagaaaactgtcaattacattttgctctgatttttctcttgtatatagtataatgaaatgttacatcaacttgccatttttaaaagtaaaaatcagatggatttagctgggcacaataccagttgtattgagaatttctaatgtcactcagatgaaagacttgaaggaaaggagatagatttagaaggaaaaggagacagacttagcaggagagatggttaatgagatcagtcattcaaataatctacctactagtaaagttagacaaacaaacaaacggcaacaacaacaacaaaaccctacccatcatctttagagaaaaatcatagtctcccacttgaaataacacattcgtctggaagcttaaataaaagaacacatattttcacacagcacaaaagaattatttttatatttggaacacgattgctacagaattatgaaaagaaaaaaatacagactgtagagaacaaaataagacaagcttccatcaagaaggaaacataaaatatactaacttgaaataacagatatacacaatatatggagttcaagtttttagtgttgactccagccgagatatatcggaggcaaagaaagatttgcaaaggattcatgaattatccaaagttaaacatgttatatctaaccaagccagacctagaacacattattggtcatattctttccattgactatgtctaattcctcttaaagttttttccctttacatataaatcctacacacattaccactttggtaagataaacagaacaaaacacttattttttctttcagcactttggatgtgctatcccattgtgttctgactaccattgtttctgatgaaaagtcaggtgttaatcataaagtcatttccttgtatggatgagttatttttcttttgctttcaagattaactcccttcacattttgtttaatccagaattattagaaactctaaatttgagactcaaagtcactcatcagatcaccacaaaatttcaaaacatacatacttagaatgtatattcttgtatatatcaatatataagaatatcaatatactactttaatgtcttcttttattaatacaaaatcattggaatatttgggaagggaatataagtcagagcaagagcatcctagattagtgattgctacatattaatcattcaatcattgtttttgtgtcaatgaaagaataaattacttccagtatttttgctgacatatttctttccctagtttcaagattcacagagaaatataccttaaataatatactttgattctcttgaaaacaattttctatctttctccccaatctttctcaatatttttaatacaatattttttgtttctatatccatcaaaaagtttcagtgtgatgagatagcataaaaatctatttagaggatcagtttggaagtcaagatgtgcaaaatgtttcttatctgctctgttctcttttcattatcttctccctgacccaaccccaaacattgtaaagaatgctaaaccctttataaagaattttaccagaatcgatattaaaattgagtgtgctatttattacttagaagtaattatcaaactttaacctgtaatctcatttatttacagtggagcatagtagttagaagaaacgtgactcaattagaggtcaattactccttagcaatgtatcagagttgggcaagttactcaacctctgctaataacaatctcttaatctgtaaaaataaatatatccatgaagtattcctaaggttaaatgaaataacttatattaaagtaaatcacttggtgtaattttgaatatacaatatgttctagcttgaattactactactaatgaaaaactgaagctcagatcaacaaaaaaatagtgccattctccaactttttctaggtagtttgctagaaataagagagcaaaatagattagggcccagtttctggatttaaggatcagaaatcatctgctgtgtttattatgaaccttttgtatcccttcagttcttcctgtaaatttttacaaagaacttactgaataaacagttaaaacacctcaaattaacaaaatcttctctactatatctccattatttcaaaaaagaaaagagaatcctttccccgttccttctttttgtcaggtttgtcaaatatcagatagttgtagatatgcagcattatttttgagggctctgttctgttccattggtctatatctctgttgtggtaccagtaccatgctgttttggttactgtagccttgtagtatagtttgaagtcaggtagcatgatgcctccagctttgttcatttggcttaggattgacttggcaatgtgggctcttttttggttccatatgaactttaaagtagttttttccaattctgtgaagagagtcattggtagcttgatggggatggcattgaatctataaattaccttgggcagtatggccattttcaccatattgattcttcctacccatgagcatggaatgttctttaatttgcttgtatcctcttttatttcattgagcagtggtttgtagttctccttgaagaggttcttcacatcccttgtaagttggattcctaggtattttattctctttgaagcaattgtgaatgggagttcactcatgatttggcactctgtttgtctgttattggtatataagagtgcttgtgatttttgcacattgattttgtatcctgagactttgctgaagttccttatcagcttaaggagatttagggctgagatgatggggttttctagatatacaatcatgtcatctgcaaacagggacaatttgacttcctcttttcctaattgaatgccctttattcccttttcctgtctgattgccctggccagaatttccaacactatgttgaataggagtggtgagagagggcatccttgtcttgtgccagttttcaaagggaatgcttccagtttttgtccattcagtatgatattggctatgagtttgtcatagatagctcttattattttgagatacgtcccatcaatacctaatttattgagagtttttagcatgaagcattgttgaagtttgtcaatggccttttctgcatctattgagataatcatgtggtttttgtcattggttctgtttatatactggattacgtttattgattttcgtatgttgaaccagccttgcatcccagggatgaagcccacttgatcatggaggataagtttttgatgtgttgctggattcggtttgccagtattttgttggggatttttgcatcaatgttcatcaaggatattggtctaaaattctctttttttttgttgtgtctctgccacgctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccatttcttctagattttctagtttatttgctgacaaaaagaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattggcaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaaaacccatcaaaaagtgggtgaaggatatgaacagacacttctcaaaagaagacatttatgcaaccaaaaagcacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactacttcaaccattgtggaagtcagtgtggcgattcctcagggatctagaactggaaataccatttaacccagccatcccattactgggtatatacccaaaggattataaatcatgctgctataaagacacatgcacacatatgtttattgtggcactattcacaatagcaaagatttggaaccaacccaaatgtccaccaatgatagactggattaagaaaatgtggcacatatacaccatggaatactatgcagccatacaaaatgatgaattcatgtcctttgtagggacatggatgaagctggaaaccatcattctcagcaagctatcgcaagcacaaaaaaaccaagcactgcatgttctcactcataggtgggaattgaacaatgagaacacatggacacaggaacgggaacatcacacactggggactattgtggggtgggtggaggggggagggatagcattaggagatatacctaatgctaaatgatgagttaatgggtgcagcacaccaacatggcacatgtatacatttgtaacaaacgtgcacgttgtgtacatgtaccctaaaacttaaagtacaataaaaaaaagaaacccccccaataaaaaacaagaaaataataataattttgtcaatgatagttaactatatgttagtcactaacactatggcagttaccttcaaattcatatttctaatatttccaatatcttcatatttatatatctaattcatatttgaacccagctctaatttaggaagttctcttttttcttttagaaattaaggcataaagtgtcacgtgacttgcacaagattgcaccactagtaaacttaaaaatatagtttacttgcctactgtctcaatgttttagtgatttattgatcatgcacaattatttttgaaaacagaaattcatttagcataccacatttcaagatccattggtagaagccactttattagcttaatcaacaaaaatgtctagaaaatttgagcttttattaactgataacatattagaagttacatatatatatatatacatatatatatatatatatatacatatatatatatataatgaaacaacccctataatctttataaaattatttgggagaggagggagcagatgaaacaaaaataagcttccagcacatccagccttaaacgttaagttaacttgctgtctgtcctgcttcctcataattgttcactaggtatggccccacaatcatttatatcctgtcacaagattatagttaaacttaactactcatagataacaacttgagcattgtaaaatgttaagttttctctttgaggtattctttcagatcctacataccagtgaaactactgacatcagctgctccgaagggctccaggagaagccgactcactaaagggcaaagtttctacatcctggtgatttaatcccccttaaccaaaccagtcagtgaccccaattttccagcccctggtcctctacaatcccttcaccccagccaagtactctctggaaagacagattcgagggtgctcgcatctcctcactcagctgccctgcaatcattaaactctttctctactgcaaactctgtttatcaatttatcagactgtgactgcacaacaggcatacaaacatgtgagtcctgtatcatttataaatatttaacttttatgtatatttaactgctataccataattgactagtttgtatgttaatattagtaggtaataataatatttatatttcctccataggtagcttctgggggcatttctgcctggtaaattttattctttaatgacaaatactaaagtaagtaactttaaaatattattgagaattttttttctattgatgggacactgaatttgtaggtggaaataaaaacctagctttttactaaacttaattttttatttaaacacaactcaaaatgtaaatataaaattaagaatttccaaaattaaacttagttttaggaactcacataagcaagtgtaatactgaagagcaaagaaactgtgctctataaaaaaaaattacaagtaattcttgaaatctaagggctaatttgtgaagtaaatttggaagctactttatgctgtagctccatcctagagaccgagagaactgcactaggaaaacctgttcaacctttttttaaccagaaattctttctttctccagaaatccttttcaggtaatgcctaatgatatctcattgaacatgtattagaaattgtagtttaatttttaattaaataattcagtgaaaatatattaattgtaaagataaattttaacacatatgggaatactagacttacggtggtcatcaacccaaaatgctacaaaattacatagaatggttagtttggcaaaaaataaatatcaccactagcaccaaaaacctaggtttcaaaaagaaataaaagaagcattccaaaatgttaaaaatttttcatttatctactttctaaatgttctttgaaacacttcttatgtcatcataattttgaagtttaaaagtaaagaaatagttattctagttaatatactaccttaaagttactctggctcacaaacagaacaaagcaaagcatgacttgacagcagtcgaattacgggaaattgaagctaaacgaaattggatacctcacctcatctaaactccttactttataagaaggaaaagcatcacaaaatgttgaggccatttaacttaaagtcatcaggtgagttagagataatttgagaccactgctttttttctctttgttactattctcttatgaagttttgcctgaaaacaggtctactaaaaatataagaatttgtaatgaagatgaacatatatcattgcctttctgcttaggattgttcaatattttcccattgataatatataaaatcctacctactttgacctcctctcccaccatttctttgctctctatctcctagaacttcattcttgactccaaagctgcaccctcctgcatcagtttcttttgtttgaaatcttcagctcttcataaatttcatccagcaaactcctatttatcctttaactccctattattttttcttacagtgccacattttccttcattagcacatatccaatttaaagttacatagtttgagtttttgcttgactttctgtttctgcactaaagcataagctccacaaaagcaagtatcatgtctgatttaacagggtatattctattcttttttttccacaaggcggtgcccggttcggtcccagacgcggccaccaaccgacgtaaagccggtgagccgctcggggaggagagaggatcggcgggcggcgggcggggaagggggcgcagacaggcaagggccggggaccgcgagggcaagggcacctgggagcccgcagaggggcggctgagggagaaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccaccggggccccgaagcgaccacagccacaaactcaacgccagggccacatcgctcgtgattctcgtccatcctccgacccggtcccgctccgggagaccggcgcgcccccaccgtgggacgctttcccagggccaggcggcccgaccacgtgccacgcaaacgccgtcgtccgcaccggtcgcgactcggcaagggagcgggcggagagctgactcgcggcggaggggggtcactcgccggacggaacgctgcgcgcagccatcgctcgctgtcagccgcgtcccaacccgctaggacgctgggccctgccggcgggatcctccccttactcggaaaggggaggcgccggccacagtaggcgacgagccgcgctcggccaccaccgcggtggccggcggaaccctcgctctccccccgtcaccccgtcgagggggaagctgaggagggttcctctgcaagcgagtcgctactgcagcgctaccataacggagagagagacagaggcggcaggccgggggatcccgtaccccaaggcacacctcttggatcgctagagaaggctttctcaccgaggatgggtcacactccccacccgccagccgcccctcgtggggcccgaggggcccgcagaggcgctcagggaggcctggggaagggagggggcctgtggtaccaggaaaaacctgcgtgcggcaaccttgagcgttcgcggtcagggcggggaccggcaggtgcgagcgtgagcgcaactccacaagcccccgcctcccacccccccccccaccccgtccacccgcctcttttcttcagaggcaaagcacctccgagtaaacccacacacgaccggtcggaggcagaacggtagcccctcggcggccggccggcgcacgcgtcaccagcccaagcccaccgcgatcgctcacagggcccgtgcgcacccgccagaggggagcaccggacgtgcgctcgccggaccaggcgggcgcccttccccgcgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgggggcgggacagcgaggtcaggccgggttccgcaccccatgccttcccaacgcaccacccgcaggcgaggaagaggagagacaaggggcccccgcgggcgggacgagaagaagggtcccattcgccacgaatgtccgcccctcgcccgtcgcggctcggacacggccagggagagcatgacatcaccatattctattcttacaagagtgctgccacgtaagtgtcaatgaatgtttgtgaaataaatgagggactaaaggagtgatcgaacaaataaaaataagttatctgtgtgtattgtatgtgtgaataagattttgagtttggccaaggcagttaatcacatattaacaactctttagatacataaggtttatagcaatgaggtacaaaattggttcaacaccaaattctaagatgaaacaaggtttatgttcagaaatatagtgttactttttctaatatcatttgccctccaactatcagcatgacacatgcaaaccattgatacgtgttttttttttttgtattgaagattccacatgaagaaaaattattatatttccaataggaagtcctcttctaaatgacaacaaatctgagggtgaacacatttgttaaaaagagagagattaaaaagttaagatgctgtttgtacagtatataactgaacaaagttgtatctagcaatttgacaagaaaggtaaaacagaatattaacctcagcacacaagtttagctaatgatctggaacggggagttgtgagtagagaggaggacaaagatgaaagacaaccatttatcccaagtttctttccaaagatgaaaaataaaaaaccctcttagtaatgttttttaaattctaactactttcaagaacacatcaataagatatagagagataacaatcaagttggacattaacttaaaagtcagatgactttttaagcataagtaacttagaactgtaaagtaaaaaacactaaatgtcaatgactttaaagtggatactgaagtaaaaaaaaaaccttctattaaaaactagactatatgcagtaacttatgtagaaagcttagcataaatatttatacaaaattgccctaccatattttattaaaatattacattataaattaagagaaaataattttaaaaatgagttatattttaggcaatttttctcaaaatgagtttcataaattgatatggttattagcatagtaatttcaataataggaacaaagaaaccaaatgaaaacctaatgtgtgtatgtgtgtgtgtgtgtgttttgtgtgtgtgtgtgtgtgtgtatacaattacctggaattccaacttcaatatgtttaaaaatacttcagtgaaaaacattagatttcttttaaggtagtttgtaagatatttattaggtttatttgtaggccttgcacactaagttaagcaacactatcataaaataaattatttaataatgaaacagaaactcaaagcttcatattataattaaataaactctaaagtatctaataacttcaactgtatgcccttaaataacatcaggactacaatgtctatcaacttgcccacagaaaaagcaacaatgaaagaaagaaagagatatctattttgtcataaaagatcaacacactttgtccaactgttggtccaactgctataaagtgggccaatgctaatggcaaataaaggagctgccattcaacatgcattctagtagtgaatattaactgactactacgtgaaggcagtgttcattgaacaaataaaagaacccttgcctgcatgacgcttatattttggtcgctttacattttactggaggaaacgtgaagaatagaataccagcaatattagcaacaacattatcccactagaagggctccagtgattgatatttccagactcatctcagtgaccctatatgatctttatattccaaggaacatggcaatggattttaacatttccaaattaaaaggtaatggtaaagtaatgataatcaacataaaaaatgactccctggaaacgaaagcaactcatttcaaatggctttggaatgccattaggacagcacctttttatttgtaatgcataagtctcacaatccagagagcaggtcttgtgaattttgatgagaggtaaggcattacagaaagacacaaaagtcacgctccagatcccagcaatatagctagtaggacggacacagagtacatagttgtactactgatcacagtgacttagagattggaacctatagttctgtgagattaggcatcatttcaagataaaatttacatttttaataaatgcagactttggctcagctaaacaaggtaccttgggctatattctttcctgtagatagataaatttgacgtaattcacccttgtgcagtctaaacataccatgtgccaacagtgatgtaagtcactgaatatgtgagataaagtatgatgaattctattgacaaatacaggcaatggcttccatttaattgagaagaaaccacatacctagcacaagtcattttctgtgcattaacttttcataatacaactatatgaagttatagcctattttatatataagcatttccaaaggttaagaaagggcacagtgagagtgagaagcacagtctgggtcggtaggacaatctagttgtctatctgtgctttaaactcctataaacatatctcccataccacagcatctaactcagagtcacattcgaattgccagcaaatggaagcctcataaacccaaaaggtgaacggcagtgaagtgtatagagcacactttgagtgcacagagtatctttgcagacagtatcttttaagactttcacaatcacatcatgagattattcccataccaaaaagtaggaaatgaaagcctggaaacaagttatatcgacattaaactgctctcaaacccaagtgtacaaatgatttttcttgcaaagaaatttatatcctacacaaagttctatttcaaaatgaattctggaattcaattaaacactcatcttgaaaacaagagtttaagtggaaattcctcactggtattcaagcaaataaattaaataatgatattaaacctacatctaatctcttatcatacatattgaaagtttgctatatagctaccactaagttatacatttccagtgacacaaaccatgaaatgaatttctttctattggtactagcaaaaaacaaacaaactacatagacggcaaaaaggtcaatctactaatttatcttctaataactttccacccaggcgcattcatccctcttattagacggttgttctatgcttctttaattttttgacattctaattgcctcacctgaaccaaaaaaagaatgtggatctaggatcaataccttttgaaaagtcatttatttcattatattaatttttcatatatctgcattattgcatagaatacccgattggtcttatgctaagtttttcatgtaacattacctctgcaagatgttaataagtatccttccaaaaatgtttgaaaaatcttgggtaaaacatattaagtaagttcctgttttatagttttccaagagttttactatccttggccaatgatgaaattcaaagcagagatatagtacacaacttttgtaaaatttacctatttttcttgtaagactgtggctttgtttcattttgttttgttttgaacttcttttctgtgatgtgacataagactgtgttttgagttaggggtggggacatgcattaacagaggtttaggaactgctttgttaaagcaagtttgagggggaaatggggagactaatacaagattttcattgaagcagtgggagttgaaggggtaggtggtttttggagaaagaagagacccattcaccgcacaggcttctttatatttctgctctgtgtgatacatagtgaagatagagacattcacttcttctatttcccacccctggccgggggtaacacaaagggacctgatgaagacacagccttatacctgtatcaagtgtccttgagagtggtaggactggagaggcctgagaaataaaaacatacatgcattaaaaggaacaaataaagagaagaagaaaactcagacatggtaaattaactttgtacctttccttacaacctagcatatcagagggtacatgatttccttttgacctgcttcctttatgctgactgcatgaacagggaagggggttggggtacacgtgggtgataattgtatttattatatacctggtattaatacatctatagagacaattggaatgaccatactggggaaacagcaagggaagaactgaaaaagctaaaataaatacttggttctataaaaaatactacaaaaagatttctcatgtctgacaaattacattttagtctaatagcaataagtagaccgaagctaaggtgatttgataaatatcataaggtattttattgggaaattgatatctatatgtattgcttgtaaagctcagtaatctgttcttgaattgagaaattacggagacaacatcaaaagctgtcatttttgtttctatgttgttgttgttattgtttgtgaggtgagagcttctaaactttatgactgtttgaaagggacctatataggccttgcctgaatattaagtcatgtgaaatgataaacagctttctgatttattgggttaaagaaaaaattgagaaattgagcatcattaaaattaaagacttttgttattcaaactgtgcttagaatgaaaagaaaagccacaggttgggagaaaatcttttcaaaacacataccagataaattagtggtatttaaagtatacaaagaactcgaaaataagaaagaaaacaactcatttaaaaaataggccaaaggtctaaatacagctgtcaaatacagatattgaaaagttactagtcatatatcattagggaactgcaagtcacgacaacagtgagatattattacatgactattaaaatggccaatatccaaaagtctgataatatgaaatgctggcaaatgtgaggagaaacaggaacttttattcattgctggtgagaatgcagaatggtacagctactttgggagtcagtttggcagtttcttacaaaacttaaacatactattaccacacaacccagcaattacattccctggtatttacttaaaggatttgaaaacttacatgcacacaaaaaccttcttcccatgaatgttataggagacttattcatgaccactaaaatcgaaatgtccttcaggaagtgaatggaaaaataaactgtggtatatccaggcaatggaatattattctatcaagccacagaagacacacaggaacctttaaatgcatattgccgagtgaaagaagccagtctgaaagtctacataccgtgtgattcaactacatgaccttctggagaaagcaaaactatggagacagtaaagagatcagtggctatgagggatttggaggagatttgcgcagtctaaacataccatgtgccaacaatgatgtaaagcactgaatatgtgagacaaagtatgatgaattctattgacaaatacaggcaatggcttccatttaattgagaagaaaccatatacctagcacaagtctttttctgtgcattaacttttcataatacaactatatgaagttatagcctattttatatataaataaaagcatttccaaagattaagaaagggcacagtgagagtgagaagcacagtctgggtaggtaggacaatctagttgtctatctgtgctttaaactcctataaacatcacctcaatctactaatttatcttctagataaaatagtagaggaagtgatgaatggatggagcaaggaagaattttaggaaagtgaatccattattctgtgtgacactgtagtgaggattatttgtcattacacatttgacaaaacctacagaattcataaggagtaaactctaatataaactacagactttggtcagtaataatgtaccaatattgactcatcaactataacaaatgtaccacactattgcaagatgttaaaagtgagggaaattggggtagaggctgaggaagacatgtgaatgcttattcacttctttttgcaaacctaaaattgcttttaaaaagtcaattaataaaaattaaaacaaggcagggttttcatgcaatggaaaaaaacacacaattttagtaagtgactgataattatgcttatgccactttgctagattacatttcattaataaatatagtttcattctttatgttataaagcagaataaaatcagatatctagagaaattgattagagtaaaagcattttcacctctcaagtcagaatgagctctttagaatcagcccattttatagctaaatcaatcattgtttgatttaaaaaaaaattgagaaaaacattaacttcactttttccacgaaactcaatgtcatgacagcattgtgagtcacctcaatgtaggattaaaagctatttctggacccaatagacttactgtgctacattctgaaaatgtaagacattaaagtccagtctttgtttgatctgctgtcctttgcagttaccaaaaggtcaatttatcctgcttcttttttctctttttcatatatcttgcacttcagcttaatattagtattaagctaaatttcttattttattttgagtgatgaaggaaaacagagattgtttcaatacagttaatgagaataagcagcaaaaggtacttataaagtacacaagagagctatcagataaaaatttgttcaaaaaaagatttggaaatttttatcgcatgaatgttcaaatggaaaggaaaactttatggattttttttccaccacacatgagtagcagcactaaagtagtgaataatgccgcttcaattagtagttttcgtatatttctgatatcagaaatgtattgttagtaactagttttaaaagcagagcattttcgtgcatggtattccactgaattccaaagcccaaacttaacttaggctaatttctctctgctggcagcaccaataatttctcataaataacatttcatatatatatgtcattctgatgatgtaaaggagttcacatattatggacctacgagccaaattcaatcaatggcttgtttcatatggctgagagctaaaaattgttttggcatttttgaagtgtttaaagaaggagaaggaaggggagaagaagaatgagtagatgaaggagagacagagattacatatggccagcaaagcctataatatttactgtctagttcttcacataaagaagttttccaatctcgaacgaaacacacacatttttgttatgtcaaaaaaggactgcaataagtcttaacatcattgataggttcttgaaaactggtaataggtatatatatttatggtcacatgtgatgttttgatacacgaatacaggagggataaattggggatggttaattggtgcaaaaatacagtaagcgaaacccattttaccgtagattgacataaaaaagagttaagcttctacggcttttggtaacaaaaacatcaacaaacttgtaaataaagatcaaaacacttctaatattaaatgctgaaataaatttgagctattcatacatttaatattaataaaaactagtaaaatcattatttacctacttatttcagtttagggttgcagttgaccacagcctatcctgtcagctcaggatgcaatgtgggaaccagccctggacaggacgccatcgcattgccggtgcactcacacatacccacagttactcagactgggaccacacagacatgtcaatcgacctcacatgcacagccttgggaagtgagaggaaactggagcatccagagaatatccatgcagacatggggagaatacataagctctacacagacagtgaaccccaactggaatctatttgttttttctcatcaacattataatgaaatgacattgaatgaaacgtcgttattcgaagacctgttgtactcagttctaaacatttcagaattaagagatctacacacatcctcctctatataatggagtgggtctcttaaaatttcctggcaacatactcttagcctgcctagaaaacactttagaatagaactgcattataatacattttcatattctatttatatcttcatatttctccctctacttattaaggtataatcttgtatatgtagtccttcagttccttaacaaggtgaacatatgatctcatgatgtgtgttttaatttcttaactttgttgagatttgggaatgtgaggaggatggaaaggaaagaaaggaactcagcagctacaaaataaatctgacctttaattttttttattgaatttgtttcttgttttatttttccttcctttgcacaaatgagagcttctagttttacaaagggtaccaccaattttaggataaacatttgtatttgtgggataacacaagttcgagacacaatgatttagagattgcatatcaattttatcaaataaatgtgatgaaagtaagtgatatgcacagtcacacacacacacacgcacacacgcatatgtagtgataaaaccattgacacagattcccagatggcacttaatgtactttcagtcttaaattctttctcaacgacaagccatttgtttgcaaatgatttagcattcaaaaatgattcaacatgagaaaaaaatgcattgcacataaagttcagattacaaaagaattaaagtcatactaatataactataatttataatgaattcaaatagctttcagaagggtcatctgtggaatgtaaagagcaatctgaatttatttttctgtaactggtcacagcaatgttttctagactagtgagtgtgtgctcatacagcaccatgtgtgttcaacaacacacaaagttggatgacaaaatcactttagtgagaaggcagctatttccaggggcaccaatactaatgttagttttgagtttttggtttgcttttgtttgtttacaaggcaatgtaatgtttaaggaaaaaagaaaatcttaccagtccatgttgagtgaacatttcaatcaatgtaaagtcaaaagtcagctgccaccatgccatgcaaaccttacagtacatgacatattaaatcagtaacctcaaaagggacttcttagaagctatgagtaaaaggcatacacaaaatgcctctgagataaattcacaaatgaaatggaacatgatatctgtgtatatccaagaataatagtaattattcaaaaacaagaaaacttctaaattgaaagaatccctaaagtaaaagtagaccaaagaaaaagaaataaaggtgagaagtgagatgaggcagaaatagtgggcgacacggagacgtactgagaaaaaaagtagctaaagatagtgtgttattatttcagcaaaattaagtatatcaatactgagaaatatgacttgaaatagattcagtacctcaagcagaaacgtaaacaaataacatctggctttttcttttgataaccagtattttaaatacaaacatctaaaaatattatctttgtgtaagagttacacatttatcattccaatcctcagggtgcattgtttccaactaaacagtaatcatttcaataacaaaaatgtgctgtaaatactgtatggaaataaatttcctaacagatgttaaccagacatcagtcttcactggtaaggattagatttgaaggtgtttgcagataattaaaacttgtttttataacataacttagcagctaagtagtataatgaaaatgggatattcaaattataagatataaaatattaaagatagaagaacatgcttattttttcaatataaatattgttacagctcagagaaacagtatgaaatctcagggctcatgaaaggccacattctagagatagtgattgacaggtatggcaattcccctacagcgtggtgcctgttgtcatggagtagcatgtctcttacagggtactaccagaaggctcaaataggaagagccaatagtccatgtgagaaaccacggaaggctaaagatagaaggaaatatttgggccacgttgaagaacaagttcaccaggtgaattggcatgtggctagggtacaacttcccatacatacataaataatgaagcagtaaaaaaattaagttatcagagaagtattttattattattagagtcatgattagcattctcctcatcaggagagttttatgtttttttctatccctactctatactttttaaacacagtctccaattttgaaaataaaagtttcttatttttaattcaaatctcaattaaaataaaacaaaaaccaaaaatgtagaagttctttattttgaccatctatatatcatacacaacaaaaagactgataaaattccaccaaacacaacagctagatccttattcccgttaatgcttaagcccattccaataaggattttgtaccaaatctgcccttgccaaggctacctagggccttcattttattatttgcaatggaccattttaacttcacatccacgttggcttccttacatcctagatgcacatacagccagattttttcccatcagatgtgatttgatcttccaacttcggaatgccctgatgacttcctctttatctaaagatcactttaaaaagcctgaagtatttggctcttccctaaatctttggccagacgtaatggcatcctcccattggctttctttgtccaaactacattagccttatctcagatcttcaaacaagttatatttcctgcctaagatgtttgtatgggtgagtgaaaggtctgatgaagatagttcctttttgcccccaaaggttttattgatcatgctgacaatgaatttattgttattttaatcttttactgttatactcaggcttaaattctctaccctatacacttcagttgacataattttaatttccactatgatgcttctctcttttctatcaacactctctccccgcagggtttcatctagatcaggagtcagcaacatttttgacaaagagccagacagtaaatattggaggctttgtgttgccaagaggcaaatttatggaaatttccctgctgaaaaatttccctatattttacattttagacttataaatgatacacctacttataactcatgagccatacaaacacaggcagcagaccagatctggctcatggactataatagtttgccaacccctagcctagattcatgattttaggcatgatctataggctatgattatctaactcacatctctagccaagtcaacttgtcagtgcctacttgatgtctccacttggattctaactagcgtcttaatttaagatttaaaaaatgtaaaatcaatcacacatatgcacctacctacacctctgtcacttgcaaactgcctcatgtcatcaagacgttgccatatcactaaaagtgaccataatccgccatgtccctaaatccaaataccttgttataattcttgctcagtaaattcaatcatcttcaaatcaacttccaatctcaactgattttctccaactttattgctacaatcataatcccaaccaccagcatccttcaactggacaggtgctaaatgaacccccttccttcactactgtacccttccacaatagtacagcctcctaagagctaacctcatcatatcacatatccatcatacatttttcaatgtagttaatttatatttacactttgatataagatctaaatttggtccctgagggcactcatgtaatatctctccatgctcttccttcatggacattccagcgaaaccggccttcttttctttgtaagaaactatcaagctgtctttttaaattacagaatctttatatctgcccttctttctgctcagagcaccccagatcttcaaagtaccttcctatttgtcttcactcaactctcaaatgaaatattagctcctgagagagaaaaattctctgaaatacttatagccagatcagtgccttcctacttgccagttttactcaaccatgttatcacatgtaatcttaagacttcatagtaatgtaccttatagcccttcacaccattgctttgtttaggtatttgtatgtcttcgtcctctttccctcctcactacagtatagccaattgtgtctttgccatcttcactgctatatcccctagtgcctggtaggctttctataaatatccatttattgacttattgactacatgtatatgctaatcctttttactaatttttgttatactatgtatttctcttctccctctctttgcttccctctcttctcatgtccttgatgcttcctactcaatattaacatgtacatcactttgtgtcttcagcatttctcttttcattatattacgataggttaattttcctaagaaaacactattttgacaaaagcaaagcattaaagtaaagcagcataggatcaattttttcctggtagaaggaaacaccatctttccaagaagacaattccgccaggaaacaaaacaaacgaaaacatttctggtaagtcctagttcccaagacttgaagccagtatattttcccactttcaagtacccttgactgtagagataaaaggtatccacttagagatattaacccattaccactgcctaaatttgggttccagaaacacaacttaatatgacatcaatggatgtgataatcatttgaaagtggctttatcaaaatcatccaacagaacaagttactttctaattagcatcttcagttaaatacctaaatctgatgaataatgttatgcattatgctaaattgcattggctcactattctagaatgctttcaaattaattaataatgatatattcagtaatgagaaatataaaaagataaaaacctatttcaatcagtttaaattagaatttaacatttcttcaatacactattttgtagtcaattgcaagagtaataaagcaaaattattgagtctttaatagtgaccattcaaaattcataatgaattattagaaagaaaactaaggtccctaccaactttccacctcactccaaaccatagccaaggtcattacaacagcaagtaagactccacacaattcccacttcttcgcctctattctattacttctggaatcttctactactccaaattgtgtgttttgctccagactcagcagttctcactaccttgttcttccaattgccatcttctcggtgtggcctttcttgactatctagttagaaattaccctatcaaaattatctgatccccatccaggattacttttcaccatctaacttacgatacttcacatatttatgtggctcattgtctgttatctgtctccctaagttagaatgcaagcttcgtgatggcagagatttggtcaatttccttcactcaataattcctgacccaaagtaaaaacgtcataagtattttttgaatatacaaatatgtagtccgaattatcaaggagcttataaataaataaagacacaaaccagcattatagtgcagtttgagaaatatcaatagtgtggtataggaggaggtatgtaaactatgagaagcaacagttacataagaagcaattcagaaagacacacagtgtgggtgatatctgagttaaaggacagaaagtaagaagataaccagatggagaaaagagaggaagattttacaaacaagcatcagaaattaccataagaaaagcaagtacaaaataatcataagaaaaacaattgcatcccaattattatgacaaacataattaactatgaaaacccaaaaacagttcatgctttgataatgctaaagttgataagtagattaagatgtgatagaacaatctgtaaatcttggtgcttcctaacttttgagaaaacatttttaggcaaaatatgatgatttaaggaagaaaagttgctgatggatgaggcatgtcccttaaagacaaacactatgaacactgtgtacagcctttataatggaaaggtgccaggttttttttttaagtccttggaatctcaggtggcaactttgaaattcatgtgtaattcatgagttttttaaaagaaatgtaataagtaacacaagtgattctagagcttgtctttaggctgagggagatattggcattataagttgaagtgttagaaaggaacaataagaattaagaataagcagtaatttctgccaagatctgtggcacccagtctcacacataaggctttttggaatctcttggtttccaaggttcaggctctcatactttagtttgtacataaaggacttaagttattcttaaagcacagttttagcacttcacaccaggagatggttatgagaccgatcacaagataaagtgaaataggatgtgtgcctgcttgtagaaggaacctctttccttctgcgtttctattcctacttttctggcaggcaagtcctagaaaaaatttcatatacagattaatttttaaacaatttacattatgttttactattattagcttctagaataccttagcttaggctggccctggtggctcacacttgaaatcccagcactttgggagactgcagtgggcagatcacctgaagtcaggagtttgagactagcctagccaacatggtaaaacctagtctctactaaaaatccaaaaattagccgggtgtggcgatgcgtacctgtaatgccagctactcgggaggctgagggaggagaaccattgagcccgggaggtggaggctgcagtgagccaagattgtgtcactgcactccagcctgggcaacagagcaagactctgtctcaaaaaaacaaaaaacaaacaaacaaacaaaaaaagaatatcttagcttatatatttctcacatctgatcctaccactttacttcttttttcctgtttataccaattatttctattcctctttacatataggcagagagataaaactaaaatgtgtcatagacagtgacatctactaaatttacctattcttcatgttgaattccacaacagatttcaaatacaaccaaaatctccaaatgaaatcttaattctaaattgagtgcttgtagtcttcaaatatgttcaaatggaacatcaaagctcaataaaaatagttatattacttgggatggtatttaaaatattttttcctaaataaattcagcttcagaggagagaaaaccttcattaggagatgtatcttaaggaacaaattaagtcaaacaaatgtgaaagaaatcatactttattatgttgaatagtaagatttttttgttactattgtgaattaatgccatccaaatattgagtgatgtaattcaatttagtaaaagaaaaaagtctaaattatcaacttctttccttataaaaatgaaatatgctataacttgcattttttccatggcaatgaccctgatgatcagaaagagaggttaaaacataaaaacatttaaaatcatctaatctaaattataaaaaagaaatccctttcttcagaaaaaataattttttaaggaagcagtcaaaaacaaatctctactagtagatatacagcatacacatctcttactatctcccatgcagactgcataaaaaggcttgctgactacttttaagaaaacaacattcagatgtctggaaagtatctgaaatgcgtgattaatctacacagataattttctcaagaaaccaaattttgaagacaagtaattcaaaagtatattgtctttaaagttaatccactggtattcttaaactgctataatactttctctgtttaccttatagtgtgaacctctcaagctatgggaatgcacgtaatcttgaagaatagttgacttcttttgtaggaaaaagctgttagaaatgactgttaggatttcaaatgtttgggagcgtgtattcatgtgggttttatgtgttgaatatttgcatttataattttaagatgcttaaatccaaaactaaaatgacccatgtaacataattctgccataggataaattaacttcaattaaatttttccatacaaattattatctaccacaatgtaaaaatatttatatatcataaagatgtaagaaacactgacatctataatacagcagagttcaatttcactactacttagcttgatgatattttaaggtcatgtctcttggaatacacattcaatattcattgccaaatgtctgaactcacctctcttgaagccatattcaattatcaaatgaaaataatttaccaagcaacctcacaaaacacaaactctaggtagcattaaggtttttcaaagtgattattccttattagtagtgatcctaagatattaaaactcatagatcgcatgatctgagattttctagttgaaaagctgtagctataaacttttaattcaaagtcggataccaccttcagctgtcaaaagaattacacaatcacttaaatttctggaatgaaagagaaaatgaagggaataataaaagtaactttgaaatgcaccgggaaacaattgtaaggaaccgaatggaggcaaagacagagagagagagggctgtttatctaaccttcccttcttgagtaggttttctctgatatctctagaggaaaactggatgtgtaacaatgaaatacaaaatacaagatattgtcttcgtataattacttgtaatgattccaagatggcagaatttgagaacttgctaaatagcacaacaaagtggtctgcttttccaaaattttgccccttaacttaaatattatttcatggtgaagatcaataaaactgaaaattggaattgccagatattatcagattttattttttgaatgcttaatagctgacccaaaatctggtcataaaaatggaagttaaattaaattgtcctcaaaatttaagtttgctacatttgtaagtgccacttgcttcttcaaaatttcaaactttctcatatctagcagcaaatcaaaattaggaatttaagcatgtaaattcatcgtggaaaccaaatggattaaaattttctgtgtattcatgataatgtttaaaatttttgctacatttaaaccctaagttagttacaaaaactctaaaattatgcttgtttaaaaacttgggctaacttgcttttgaaaacatactgacatattcattccattcttcttataattatttttgtgtcactcccaaacagcacaccattgtatatgtccccaaaatggcacttctttgttaaagccattaagacagaaatatttttgagccagatgcaatggctcatgcctgtaatctcagtacttagggaggcctaggttagaggactgctcgaggataggagttcgtgacctgcctgggcaacatagcaagacccagtctttacaaatgaaatgaaaataaaatataaaataaactagctgggcatagtagtgcacacctgtggtcatagctatcaggaggctgagatgagaggaccatatgaacttaggagtttggggctgtgatgagctatgattgcaccactgcacttcagccagaactccgggttgctgaggaaataagttctcagttctgaatataaaaactgctcctgacactccccagaatcctgtaaatgagctgggttttctggtgcctctctatagtccctctttctcaggaaacatccccatggttttgcctgctgtgatattaattacacccatgcttattatatgtcagttcagttttatctagattctcccgaagtcagtgctgaacttagctgtttgaaaatgtatatattgtaatagttaccaaaaagacaaaatacagctagatatttatgctatttgttttatttccatcgtaggtatatttccttttaaaattcatatgtatctttttctaaggattgtctccattttcagatgttaaacactttctcatgcacaaaccacttaagcagcatagacacagagtccacgtcagggaatgttacattcagtataggcacctattatttggtaactcagaagtaggaaaatggatgtcctcaagcagatgcttttcttgacagatacaaaaaattgacaaggatcattgacttacttccaacccaccattcatcccttttctcttattttgaccctaagggtcccagagggataatggccctacattgttatttagaattcagatttcagactgcatttcttataccatttttataagtagtggttgcacacagttgagacaatactatgatattaatctacattcctcgttaaatcgacttttgtcttccatttttttagcttagctacaatttctcacacggtttctctaggaaggaacattgggatttcccaatgacttaaacatttagaacttagtctattcataaatatgaagagcttgtgtagaaagtataatttacttatactattatgcttaagaaattatgtgaaataat

SEQ ID NO: 580 - DNA, 106805 bp, Homo sapiens
tctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttccccacattcattgggcttttagttaatctcctccatcccactctttacttcaaccaaatcaaccaacatttaaacactcattttcaagctgcttttctgtaattccaatttgttgggatttccctggcccctatcacttgtgagttcagttttatgggtgagaggggacttgataaagaaggcacaatttttttttcataccccaaatgccagggcaataagccaagtttatacttgatgcgtcctccattttcattagcaatagaaacagtatagtgctactaaggtcaggggtttgaaccctggctctgctacctttcaggtatgcaatctttcggaaattctcttaatttctttgagcttcagtttcttatttctaaaagataattaatactaccagattatagtgattactgtgagggctaaaagacttaatgactacaaaatactcagcacagtccctggcacctagtaaatatccaataggtcatcgcttccagtgttgtttttattactgggggatgctgctgtccacgtaccaaaagagaactgtaaaaaacagcttgcaaagtaagagaaggaagggaagtgttttaatgtgtaatggcacattacattttctggtaatcccaatgttactttaaaaaatcttaaaaatttgacagtggtagcacagtttatttagagccttgtcttggggataatatgaatttttctgggaggattatacataccaggcttcttttcctgtgagagcaaattcccttggacttcttaaatttctgttttcttggtgtagagactgttttctctaattcactgtgggttttctgaacttttccccgttcaatcctagtggtttcaatctgggctgttgtaagaatggcttttagaggaaagagatattagaaatgacagcttttcaagatgaaaaaggtgccttaagactccaaataattctgttataatttttcatttcttcttaagcattttacggaaaatggcccatcttgagtatttttatccttgggcctaaaaacaagttcttgttagccagcggctaggcctttgaagctgcagtgcttgtattttggtctccaccctcttggatgacttgtggaagtatcttccaagctccttcctgattgcgtttccccagtttcaactgagaaggagaaagaactgtgactatatcgatgatttcagaagtgtaaacaacttatcatgtttgtggaacactggataaccctcacaggggatgctgaggaatctggatgcccatggatttttaataatgggagagaatgctatttggaaatcagaggattgaatggatcttggattggatcttgaacacaagactccaactccaaaataaaaactgtgggctgaacaatatgcaattatatatgtggttgtataatgtgcttccatttccttactacaccctaacaaagtctttgttgctggcagggagatcagcctggccttaagaatctgcttctgctagttcagatgggaagtgattagtgtttgtcatatgcttaaaatcctttatgataaatggcacaggcagttattttcgtatgtacacagaatacatcacgaagatcaaagaactctaaccagaggccccatttccagctaacaggtctgagtctatttgggtttagattgtaaaacttcaggaaaatctaacgagcttatgttaccctgaacaagaaatgagatttcttagtaatacccactattgctaagtgactattaaggtagccaaatatcattctttacctatgctttagtttaaaatttcaaagagaggtatggtcagatttatccatgtgttcaatatctaagattttgtcttttaagggaaagcgctttctcctctgattttctgcctaggggaacctcaaggtatctatggcgtaaaagccaaacgtctgttttagcaaatagccagacattacagtggggagtatgtagatcatcttgattattttaccaaccatcagggcagagatggaaacattgtgagctgggaacattgagtttcatttttaccagtatccttgccttttagaaggtatctgttaggagtacttaaagtaaaatggattgtttctaaaattgtgagatgagctatagggcagcttttctacttaattagcttttgtcgttttgtgtttctgttgagaaaagctgagtgggacccaagctatccattcactgcagcatccaagttgcttagaatccttttagaatttagctaagaatactgtttctacccattccaaaaagtatagctagataatttgtaaattcaatttcatgttaattataaacaatttcttgtgctcctttctgtactgtgggtatttaccgagttcaaccatagcttatacctcatatgagaaagattaacaataaaaaatcttttctgtgcacaagtgggggtaaaagactcattatcttctctactttacccccagtgcacccaggctccaaactccagaatcatatattctttctccacttccaatctaatattaaatcatgttgatttttgtctcaacaatattttttgtttgtttttaatttttcattaccgttgtcattatcttagcttaggctctcttctttcatgaattaagcttttccttattatgcgtgaagttattaattgaacaaacacttattattcacctactaggtactaggtattagtaggtgggaataacagcaataatcaagataaaaccttatgttgggtacaatcttcttactcaagtcactgaaaagcctttaaataggtcctttatgtattttctctctctactccaaaacattaaaaacataattgcaaaactagttttatgtaatgcttcattatggcctgagatatcctaatagtgtggccatagtcttctttctagggttacttcatattattttcttaattttcccacattttagataaatgcatgtgttaggtatacgttaccatgattcctggcctttcgtatagcttcagtggttatgttattcttgttgtatgggaatgctttcctctccatctcatatgttaaaattcatccatcttttttttttttccaaaaaagtgaatatttatttatttattttaaatttaatttaattttaagttctgggatacatgtgcaggacgtgcagttttgttatataggtaaatctgtgccgcggtggtttgctgcccctatcaacccatcagctaggtattaatcgtccatcttttaaagctcactttaacttccacttttccatgaagcttttcctgatcttcctcctccttccatcctggaaaatccttgcagtttgttctgcagcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttccttttgtttgaagtggttgatatgaactagagtttaatcttatacactcataaaattgcacatggcaaatactttcacaattgctatttaaaaataggcctatatacttacacactactaataatgtgtccctttacatcatagccttacagcattaggggaaagtcattatctcccctcctcctatatctccaaatgttctctgagggcttacgtctcttatagtcacctcttgttctgacttctggattctcaaagttattttcctcacctgcattttgcttcttttggctgttctctctcctccactagcatgtaccccaaagcatcaatttttctttggtttctcaaaatatcacttaaggcagttgtctgtatgagatatttaacagagaaaaagctatcacaaaggtttactttatatcataatgctacagaaaaatttaaattggacttaggcacaagttcttaaactttcttagccactgtaaatattttatagactgacttctctcttcaatttctagggtctcctgccatatcactgatttctttccattcccttattgctaatctttggcgcctaatctcctgctaggtggttctggaaatatcacaacccttccaaacttaatatttctctagtctctatctatcatgacctggggctatgattccatagtcataatggcatttttttcactaaaaagataattatctcaaaatgagtcaaagacttaaatgtaagatctgaaactatgaagctatgagaagaaaacataagggaaatgctttaggatgttggtctgggcaaagattttatcaataagaccttaaaaaaacaagtagtaaaagcaaaaacagacaaattggagggttatatcaagtgaaaaagtttctgtacagcaaaggaaacaatcaacacagtgaagagacaatctacagaataggagaaaatgtttgcaacctatacatccgataaggggtcaatatccaaaatatacaaggagctgaaacaactcaatagcaaaaaaagccaataacccaaaagacctaaatagacatttctgaaaagaagatgtacagatggccaacagatggaagaaaaatgctaatatctctaatcatcagggaaatgcaaatcaaaaccatgataacatattacctcactcctgttagaatgactgttgtcaaaaagacaaaaggcaacaaggtttggtaactatgtgaagaaatgggaacccttaacacactgttggcaggaatttaaattagtgcagccattatagaaaacagtagggaggtgtcctaaaatattaaaactggaactatcatatgatccagcaatctcactactggatatttatccaaaggaaaggaaattagtatgttgaaaatatatctgcactcccatgtttattgcagtgctattcacaatagacaagatatggaatcaacctaagtgtccatcaacagatgaattgataaagaaaatgtggtatatgtatacatgagggactattattcaaccataaaaaagaaagaaatcctgtcatttgtggcaacatgaatgagcttggaggatatatgttaagtggaataagccaagcacagaacgacacacaccacaagatctcactcatatatggtagctaaaaaagttgatctcatagaattagagagtagaatagtggttatcagagcttgggatgggtaggggagtggaggatagggagacattggttaacaagtacagaattatggttaattaggaagaataagttcaagtgttctatagcacagtatgaagactatagttaacaacaatttattgtgtatttcaaaacagttagaagagagaattttgaatgttccaaatataaagaaatgataaatgagatgatggatatcacaattaccctgatatgatcattacacattgtatatacttgtatcaaaatatcagatgtatctcataaatatatacaattattatgtgtcaatcaattttttttaaaaagccacaataaagaaaatactttaccccaaagataattatctccttaagagaaaatttgttttaataaaaacttttattttagggccaggtatggtggcacatgcttataatcccaggactttgggaggccaaggcggtgggatggcttgagctgaggagttcgagaccagcctgggcaagttggcgaaaccctgtctctacaaaagaaaaccaaaaacaatagccaggtgtggttgcacgtgcctgtagtccctgccagttgggaggctgaggttggaggatggcttgagcttgggaggttgaggctgtagtgatcaaaccactgcattccagccttggccacagagtaagaccctctctcagaaaacaaaaacaaaaacaaaaaacacttttactttagaattgttttagatctaaagaaaaattacaaagattacaagaaagttcatgtgtactgtacactcagttttccctattattaacaatcttatatcctttctatcacattcctgacaaatagtaacatctgcttaaatacttccagtgactggcaacccagtatgtcttaatgagccccattgccagataactctagagcagtgtgacttgagatgtagtcctaggaccagcagcagcatccatacaacctgggagctgcttagaaatgaagagtctcagatctcattccagacctgaattagaatctacattcaacaggatctccaggtgattcatgtgcacatccaaatttgaaaagtattgctctagtgttcatatacatatatatatatatacacacacacacatatatgtatttttcccaaaagatggcaaccaaggtcttgcaatcacattgccccattcattaatttatctgtgtattcacaaaacatttcttaagagcatattatgtgatttaatttgaattttttttagaaaaaattatccctaccctaaaaattttcacattccagtcctgtcatgcaaaaggtagttgaatgaacagggtaatttttattcagaaaagagaggactaagtttgaagagctgaccctgaaagaaaagcaaattcagaaaaattcaggaaaagcttattctttataatatccattctttggtctcaactgggtttcttttaactttgtgtgcatctagtctgtttcttattccacatgacagctgttcagataatcgaaggcagaatccaagtttttacttggctggactcttcctagattgttcaaggctagacacccttcctgtcttgagctgtccaatagtaactttgtcctgcaggattgcttttacatgaatgtcagggtctgcaactgaaagattgatgaaagggaaggcaggctacctcatccctttgccctaatcgtaggtggaatgggaatgagagagaaagaacattatgagtgggttgtttatacactcaagcctcaggacatataaacaggatgaaaccacttatctcacccttactgactgttttctacagattgtggcattttcctgtatttgctcttctctcaggcacagctcttcaaacttagtcttctcttttctgaacaaaaattaccctgttcattcaactgccttttgcatggcaggactggaatgtgaaatttttgagagtagggataaggtcttatttaaaaaaaattcaagttaaatcagtgcttagcaatcatatgttcttaagaaatgttttgtgaatacacagatgaataaatgaatggggcaatgtgattgcaagaccttgcttgacatcttttgaaaacatcttagtgcgttactgtcccctgtccctgataaaatgtggcatcatgaattgagcagaatactccatatggtgtatgaatattgtaggatagtggtataattaatttccctaatttagaatttactttttgatgagttcagcctaataaagatgaaagagaatatgacccccatcattatggcggtctgtgtttagaaggccaaaatagacccctacaacgttgacttagcttatcagtaaggtagaatttgctttaaatggcaattttgagatttttcttgaggagctgaaaggctttacaagattaggaaggtcccccactggctaaataactgctgagggctttcccccttttctttccatcattctttgcttccttctttctctaactgcattgcaagccacttccctcacctgaaattactttttttttctgtaaatactattacaaaaaaaactgtaaaagagagtggtaaatgcagagtagatggataaacataatgacccaagaatgacgatggcgaaatatgacattttctggtgttgggtataataatgggtagagacggaggaatggaaaaaatagactagctcttttgccatggcaacaataagtgcatttattatataaacagaagaaggaaaggcatttatttggtccttgttccttttccctcctaattctcagtttctcctgttttttgtttagtttagattctcaaaagctggaagccagttaccttgcaaagacattgatcatttctttaaatacccaggtatatgcttgactccataatattttactgtttaaaaataaataaatgaatgttttctttaaaagctgattgaagaatagctcaagtcctcttttatcaaacatagaagaatgctctctttaaaagtttgcatctttatcttgagtcaataaccttacaagcaggaatcaaggcacagttttctttccaattgagtatcattagaacattgtctggttcattcatgtatgtctcaagggtaaatggccatcagcgagtctctgacagagaaatactaagtgatcctagtctaaaaggaaagccaatgtgcacttgagtagcagcattcactttacagagagttcaaagggcactttactatgtctaaatgccctttatgttctctggtgccagcaggaaaaggaaagctattaaatgcttataagagtgagacactgtattttaggacataggaaagatggggggaaatagatggcaaactaattgtaagtcaagaatatagcgagtttcccaaagagaattcctgcattttcaaaatattcttcttttttaagggtgtgtggggtgggtggcgtaaaatggaaaaatatgtaaagcctcatttaatatgttttctgaataatccaaaattttcaacatgagctgtaggttgggttgggttggggcaaatcgatgaggcaggagcctaaaattataccaaatttctggatataaatatcagccccaccattattagatatgtgaattccgggaagatacttaatgtctttgagtcccagccttcacgagtatacaattaggaggataaattccaccacggagaaatgttgtcaggtttagtgtagtaacatatataatgcagtcagtagggggcctggcatgtgttagggcttcaaaaataagaaccacatttccattcccactgtcccttaggatcaaatctgcagacatcttctttaggcatttaatacctcccagtattccttgtctacagctcatcgatgtttgtttaccccaagtatttgtataaaattttacacacaaccttcctaacttacatttaagactgtgccatttctgattttctagaaaagagttcagattccttatcacagcatttaaggacatccatgttctgaccctgacctagttgggctgtgtccccctccaactctcatgttaaattgtaatccccacatgtcaggggagggagcttgtgggaagtgattgggtcatggggttggatttcctgcatgctgctctcataatagtgaatgagttctcatgagatctgatggcttaaaaatatggcacttcctccattgctctccctttcctggtgccatgtaagatgcgccttgcttccccttcaccttctgccatgattgtaagtttcctgaggcctcctcagccatgtggaactgtgagtccattacacctcttttctttataaataacccagtctcaggtagttatttataacagtgtgaaaacagactaatacagacccccccaacaaataacatctcctttataaagaccctatgttatattggccagttcctcaatatgttctgaaatatttttcctccataatttcattcacttttcccctgactataatacagttgacccttaaacaacatgagtttgaacagtgcagtttcacttatacacagattttcctctgcatctgtcaccctgagagggtaagattaagcctaccttttcctcttccccctcagcctactcaacatgaagacagtgaggataagacctttatgatgatccatttccacttaatgaatagtaaatatattttgtctaacttacgattttctgaataacattttcttttctctagtttaacttactgtaagaatatagtatataatacatgtagcatacaaaatatgtgttaattgacaacattatttgtaaggcttttggttaacagtgggtaattagtaattaagtgcttggggagtcaaaagttatatgcaagtttctactgcacgaggtgttggcacccttaacccccacgttgttcaactataccttccatttctgcactttgaaaggttattctttaaattccagcatcaatgtcatgccctctatgaagtcttcctgaatactttggacagaagtgatttctgttcttctggaattgcctagtaattcctcataatattaataataaagttctatacattcgtataatgctcaaatcagtggacacttcctgatttagatatgatttaacctgcatagagtagttgacaatacaagtgactttccatccattttcctcctctgacttctgaaacattctggttttcttactacctatatggcttctctttctcagtcttctcagtgaatttattcatttcctaggactgcctttaaaacatactacaaactgggtggcttaaaacaacatgaatttattatctcagaattctggaggctagaagttcaaaatcaaggtgttgggagggccatactccctctgaagcctttaggggagaatatcccttgcctcttttagcttttggtagcctcaggcattccttgttctgtggcagcataactctaatctctgcctccattttcatgtggctgtcttccctctgtcactggtgtccttaaaagaagagaaacagacacaaggaggaaaaccttgtgtctgtttctcttcttataaggacactggtcatattggattaggtctcatcctaatcaacaatgacctctcatcctaatttgattacatctgcatagagcctattttcaaataaggtcacattcacaggtactaggggttaggacttgaacacatcttttggggggatacaattcaacccaaaacagtagcgttcccatttcttgcctctcccttaaatattaggtttcttcagagtgatttcttaggctcccttctctcagcaattatttaaataatgaggaaaactaaaatttggcagtgtcaaatatgtgaatcataaaacaggtgtaacacaagggtccaaggaggatattcgagatacagtgttctgatgcgtcctccttgaatgtgactatattcccttagcttttcctttagaaccacacttgaggtggtggagcctttaaaaatatttaacaaatgttacttttgaagaagagagtaagagtatttaataaggtaacattggcaatgtgaaagttatatgagatacataatcagtggtcctcatctttgtctccttcttaaagaaaacaagaggaaatgattgaccactggaagggtaatttttgtgggctgaattgtacattccccaaatttctatgttgaaaccccaacgcccagtacatcagaaggtaactgtatttggaggtagggccttgaaagagacaattaaattgaaatgaggctattaaggtgaaccctaatgtaatatgtcttatgaagtcatcataagacagggaaatttggacataccaagagactccaggtatgtgtgcacccagaggaaagaccatttgagaaaatgaccatctgtaaaccaaggagagaggttttaggagaaaccaagcctgctggcaccttgatcttggactttcagcccagaactgtaaaaaaacacatttctgatgtttaagccacccagactggcattttttttttatggcagcttagcaaacgaatacagcaatttttagttactgatttagtgactagtgtggtccagatgctattctgggtgctgacgatatagcttccctgtggagctgatgttctagcggatggagaaagggaataacaataaataagtaaaatatatgtcagatcagactaagtgctacagagaaaagaagtcagagaaatcatcatatagaaagttgcaattttatagttatgaagccttcattgtgaggctgaaattttaacaaatatctgaataagatgaggaagaggcagaggatcccaggtttaggaagtagcaagttcaaagaccctgatttgggattgtgtctgacatgttcaagagacaacatcaagaagccagtggggctgaaatgtatagagcctggggggagagtaacatgtcagagagaatgggggtgggggagctatggagctactggggactaacttgtagagaaaaccagtccccagaatgaagttaatacaaaaagaagggtgagcaggcaaaatgggggagggtatggatgagggagggagagagaaagagagagaaagagacagagagacaaagagaaagatgccagtctgaaaaggctacacactgtatgatttcattatttataggacattctggaaaggcaaaactatggaggcaacaaataaatcagacattactggggtttggggagagaggaaggttgaacaggtgaagcacaaaggatactctttgtaagtgatgaaaccattctgcatgataccataatggtgggtactcaacgccatgcatttatcaaaacccatagaactttacagtacagagtgaaacttaatgtatgaaaattgtaaaaaaaattatttctgaggtcagagggtcacagggtggaatatagaacatgactaaacaattaacaatgctacaaacatatgataaaacctcactgaagggactggcagaaaaagttgctagcctgaataactttagaaatgagcagagattgtaagactaaagggaaaaataattgtatgtaagcacggtaatctagttgataaagtctcccatgggggaacaggttaacaattctgaaaccatcatacatctaatctggaactgaagaattaagtaaatggaatgtggatagcaggaagcacgagccaggtttctcactgttgaagtgggagcttacaggaaagcatggggagaaggcaagaatgattcatatggttatggattagagttagagacatcagtatgaactcatgcttacattattataggtacagacgtttacatatagaaatatttatagatacgtatatatactgaagttagctacacacacacacacacacacacacacacacacacacattttgctctgtcagctgaagaggtcaagatacaaggatacacctaacaagtcagatctttgtttctaatactatttgttccaataaaaggaaccagggatccttagagagacggctgattctcaggaagcatacaatataagtctggagcatgttgtagtttcttaaaagaaagaagtacttaatacccacaatgatggagcacatcaaagggagactagagccaatgtaagcagttcctaatggcctacgctgggacgatttgagcaataagataaataaggtagcaatggattatgattcaggtatatatacaataaatattcctgtctacactgacataaataaacagtcgagtaagtaaacaaatagggaacaagatacatctcctgtgcaggagaatttcaaatagtttgtgaagctcttccatcctcaaggaggtagaacataactcctactctgtaagcatggatcgtgcatagtgatttccttccaaagagtaccatatggaaagcttagaaaagagtaactttaaagggtgaaacctgataaacactacctcagccaggtgatcaaggtcaatattaaagtggtaggtcatgttgatagtatgtactcttgtatgatgcaatggaaatgacacttaacttctgtggtcttcctctgcatgtaacaaacatcacactgcaatcctgagaaaagcattaagcaaatcacaattgaggggcattgtacaaaatatcagtacttcttaaaactgtcaaggccatcaaaaacaagaaaagtctgagaagttgtcatagccaagagcagtctacggtggcatgcgactgcaagtaatgcagcaccctggttgggatactggaacagaaaaatagtgtgaggttaataactactaaaatatgaataaagtatggacattaattaaaaattatgtaccaatattggttcattggttatgaccaatgcacctcacttatataggatagaaataataggggagattgggtgtgaagtatatgggaattctactatctttatcacttttctgagcatctaaatcttttaaaataaataaaaagtttattttaaaaaatctcattccaagttttaccccattccaattaaatcagaatttctagggtgtgagaagggatcagtattttttaaacatctcaagtgctgtcaacgtgcagcactggaaacctctgtagtagaagtccctgagctgtggtagctgttatattttggtactccttaattcatacaaaatgtcctgagctaaatgaaaatgttgtgtgttgcctccattttgtacctatgtgaagtcaaaattttaattatgagtatgataaaaataaagtactggaacatgttgcccatttgagcaccacttgatgttacactattggatattgagctcctaactgacaaatgtatcaagcatataattacaagcaatattacatcttaaaatgtctcgtaattttcctccaattgaaatgaaaaaaagaaaaaaggatatgacatgcatactctttcctctgtctgatccctatgctgtctgatcccacattaatatgctttggtggattccaccacgattccatttttctgccgttttttgaccttgtttgtactccaggaggctgactctatggactgcaatcctcaggcctccttgctctctgatttccagttaggtttaggcaagatggaggagacaggtatcatcgttttaacccaagtctttcccttcttcatcatggttctggcagtggctgcgtttgttgcaactccagctcccaccccctctggctcacacttggctctggaaacacagttgccttttctcaccccttcaaactaagagggagtaatggtttcctgctgttgctagtctctaggtaactcaccatcccttttttttttttttaactttactaatatctctgtaaattgtctctttactgaaatattttaactttttgagggtgtcatctgtttcctgataggctttctgactgatgcaattagtctatcattgtcaattctctggaaatgatgactctttctcccccacctctttttaagccaagataacgtcttgcctacttttctggccttaaaaatgttctttgttttgtgaaacaatgttgataatagcgaacattattttccctaaggccttatttggcaaaagtaagagctggcaaacatgctggttccccacatatttttgaaatttcattttcaaaactggagtctgggaaccattgacctaagtgagaattcaactttgaaacattaaggggattcagctatcattcactttaccacaagaatcttacaaatctgatgaaagttgccaatggctgtcacagtagacactcaagttaccgggattcagttgtttgcataacatattgtcccactcctggtaaagagggaagtagtatctgggaaaagtaggaggatcgataaaaattgaagtggttatttttgtatccactgacacagaaggagattttacagcacactatgttttgagtctcaaaaacacacgtattgcatttcactggagatctgatgggggaagggatggagaagaggaaaagagtgcatctgaaagttttagcaagaagttgcaaggactcttcaattaagtatggatgcagtgtgacagtgacttagaacttccatgttcacagatccagcgctgttaactttatactagtctaagtcttttttcttataaataattacaaaagctcattaagcaatacagactgggaactttttttttcctccaaattctagtttatttttaattgacaaatagtaattttataaatttatgggggtacaatatgatattctgatacatgtatactctgtgggatgatcaaatcaggctaattagcattatcagtcatttcaaatatttatcatttctttgtggtgagaacacttaaaatcctctcttagagattttgaaatatgcaatacattattattgcagtcagtatgctgtccaatagaacaccagaacttattcctaactgaaacttcgtatcagctgaacaatatctctcctttccctgtccacactctcacccactgccagcctttggttaccacctttttactctctgtttctatgagtttgactttttaagattccacataaaagtggggtatttgtctagccacgcctggcttatttcattttttttgagaccaagtcttgctctatcgcccaggctggagtgcagtggcgcaatcttggctcactgcaacctctgcctcctgggttcaaacgatcctcctgcttcagcctcccaagtagctgggattacaggcacccgccaccacgcctggttaatttttgtacttttagtagagacgggatttcaccatcttggccagggtagtctcgaactgctgaagtcaagtgatctgtctgcctcagcctcccaaagtgctgggatgataggtgtgagccaccatgcccaactgcttatttcacttaacataatgccctctaggttcattcatattgtcccaaatgacagagttttttaaaatgctgaatagtattccattgtgtgtgtgtgtgtgtgtgtgtatatatatatatacacatatatatgtatatatgtgtgtgtatatatatatacatatatatgtgtatatatatgtgtgtatatatatatatacacacacacacaacattaaaaaaaatccattcatttgttgatgaacacttaggttgtttccatatcttggctactgtgaataatgctgcaatgagcataggagtgcagacatctctttgacatatgatttcaattcttttgcatatacccagaggtagaatttctagatcataaggtaaatctatttttagttttcatatttttaaaacttcatactgtttttcaaaattgttttcaaaattgctgcacttaattgtaataccaccaacagtgtacaagggttccttctccacatacttgctaatacttatctttcgaaatagctgatctaacaggcatgaggtgatatcccattgtagttttaatatgcatttctctgataattagaaatgttgagcattttggtaaatgtatgtcttggccatttgtatgtcttctcctgagaaatgtctatggaaattctttgccagttttttcattgggttatttgttttcttgttattgagtagtttgagtttcttgtgtattttagatattagcctcttatccaatgtataacttaaaatactttttcccagtttatgggttgtttctttactcttttgagattttcctttattgtgcagagtttttagtttgacgcaatcccatctgtctatttttgcttttattgcctgtggttttggcattatagccaagaaatcattccccagaccaatgtcgtgaaacttttccctaggttttcttctagtagttttatagtttcaggtcctatgtttaagtctttaatccattttgagttgaatcttctataagggataaggtaatggtacattttgattattcttcatgtggatatccagttttcacaatatgatttattgaagagatgtcctttccccattgtgtgtgcttggtatctttgtcaaaaatcaattgactgtagatgtataggtttattcctgagctctctgtgctattctgttggtctatgtgtctgtttttatgccagtaccatgttgttttgattactataatttagtaatatattttgacatctgatagtgtgatgaccctggctttgacttttctttctggtcaagattgctttggctatttggggtcttttggacttcatacaaattttagaattttaaaaaatttctgtgaagaatgacattagcattttggtagggattgcaatgactctgtagattgctttgagtaatatggatgtttaaaaaatataaattcttccactccatgagcgcacaatatctttccatttatttgtataattttcaatttatttcatcaatgttttatagtttttggtatacagatcttccacttcctcggttaaattactcctaagtattttattttttttgatactaatgtaaatgggattgttttcctcgtttctttttcagttagtttatggtttgtctataggaatgctactgatttttgtaggttaattttgtatcctgcaactttactgagttagtttatgagttttattaatttttttggttaggtcttcaggattttccatctataagagcatgtcatcagcaaaaagagataattttacttctttctttccaatttggatgccttttacttcttttctcttgcctaattgctctggctaggacttcccgtactatgttgcataggagcggtgagagtggatatccttgccctgtttctgatcttagagaaaaatcttcagcgttcacaattgattgtgacattagctatgggtttggtgtgtatggcctttattgtgttgaggaacattctttctactctgaatttgttgagcgtttttatcatgaaaggatgtttaattctgtcaaacccttttctgcatctattatgatgatcatatgttttttgtccttcattctgtgggcatttttgtttattgatgttttcaattgaatgtgttttataatgtcaagtacatcaaatttagaacagaaagaaaaattttacagtatcttatgcttggatagggtacaagaaacagggcgtatgtttatcacagtttagtctccttgactttaaaattcttctgtgttgggaatatgaggtccttctttgttatgttatgttatatttaatattgagtgaaaaggaattaacacacaattgttttttaaatttttatctgtttaaaaacttcctttgtttttattctcattactttctgttttctgactttaccttaagaaaaacacagagcaatcttttccaattcatttttttcctttgtatacatttaaaagggagttttaaaagggctggatagcttggtcataaagaggagtttttctttaccattacaatccaaacacaagctgtcgtccacatggcatggaataattagagaactcaagaattttctttctcttgacatttctactacttaaacaaaataatggaaactgatttatttcttcctttatctggtgatggaaaccaccctatggaaaacctgggaatggtcagcactatgttttccactatgtggagagagttggtcagtaacaggaaatgaaactgactcatatggagaagcagagacaagagataggattactggtgattttagggttcccgaagaccatctacatatctcccattcctgttgcctgactgttgaaatttttctgattccatgaaataaaaattctcctttttggctaagctattattttgggtgggattctatagggtgcaagtggcaaaaatgtagctacaattagcttaagtaaaaagagggaattgaggagagatccttaggtaactcacagaattaaaggaagactggatcaattgagctttagcaaggcagaagcaagcactttagaagggactcagaacctagggccaagacttaggtaatgcagcagcacacttccctcacgtggcctttgctccttctttctggacactgtgctctctgtggaggaatactttgattaccttatgtgtttccaccagtactttatttaccccataaccctcatctattcattggcatttttatgtgcattgccacagaaggagacgttacagcacactgtgtttttgaatctcaaaagcgcagactaggattgaattcaggctctgaagattaagagagctatcccacgttagcgggaaaaggaaagccaaaagggaaagaaagacagctgagttggtaccactgggaaaggggccctgcacctagtagatgatactgtcactaggcaacacacagggggcatttgtgtttattgttttaaattgaatatgttttataatgtcaagtacagccaatctgtaattgaaacaaaaactttgaagtactctgtgaaattcatctctgaggactgaaccctctgggggaggagcaatagacactcccactgcaccccaccctgggtgacagagtgagaccctgtctcacaaaaaaaacaaaacaaaacacttattttagaattgttttagagctaaagaaaaattgcaaagatagtacagaaagttctcgtgtactgtacacccagtttcccctattattaacaatcttacattctttctgtcacatttctgacaaacagtaacatctgcttaaatacttccagtgactggcaacccagtgtgtcctaaagagccccattgtcagatgattctagagcagtgtgactagagatgtggttctaggaccaccaacatccacacaacctggaatctggttagaaatgaagagtctcagaccccaatccagacctgaatcagaatctacattcaataggatctccaggtaattcatgtggacatccaaatttgaaaagtattgctctagtgttcatatatatatgtatacacacacacacacacacacacacacacacacacacacacacgtgtatttttcccaaaagatggcaaccaaggtcttgcaatcacattgccccattcattaattcatctgtgtattcacaaaacattttttaagagcatatgtgctaagaactgatttaacttgaaactttttttagaagtaagatcttattcctacactaaaaaatttcacattccaattctgccatgcaagaggtagttgaatgaacagggtaatttttgttcagaaaagagaggactaagtttgaagagttgtccctgagagactagcaaatgcaggaaaatgccacaatctgtagaaaactatcacaacagctgagagaataacagagtagaaagagctactcccctttattccagatagagctaggggtggagagaaaacccctctgcaactcgggttagtgtattagtctgctctctaattgctgtaaagaaatacctgagactgggtaatttatagagaaaagaggttaaattgactcatggttctgcagactgtacaggaagcgtagtgacttctgcttctggggacgcctcaggaagcttccaatcatggcagaaggcaaacggggagcaagctgtttcacatggtgggagcaggaacaagagggtgaagggggagatgctacacacttttaaaccagcagatgttgtgagaactcactcattacagcgaggacagcaaagacccatgagagatttgcccccatgacccagacacctcccactcactaccacaagaacagcaccaaggggatggtgctaaactattcaatagaaactgcccccatgatccaatcacctccctccaggccccacctccaacactggggattacaactggacatgagatttgggcggggacacaaatctaaaccctatcaggtagcatggggcagtatgtaggaatagctgcgtgatgaaggtcctcagatctgaagcagcctcatggagttccaacttgcctcagcaaggtgtaggagcagtagactaattcctgagcctagcatagtcatgttgctgcgccttcacccaggtgcccagatcccagaatggtgctggagaacacttttcaatgcacttcagcagggcatcaggggccaggaaggagagtcattgatcctgaagtgacctttggcatggatccatgtagatcaacacttgaaaaacagacaggatgaggagggagatgccaaattcaacaaatgaccaaatatcagaacgtttgcttattctggccctgccttccttctgtcccgtgtcccttgcttaaaattagatgtgaactgaaggaaaagaaatgggagcctgaattcattgaggctgagtttctatcatctagtaaaacaggatctcattgaagaaattaagttcagttgcatgaaaaaattaagccacgctttctgatcatctgcttatgtgacctgaaatttaaattttgtcttctacttcagactgtgttcttatatgcggcagagaacctggctactagcagctgcagcttgcaactgcatatattcaccatctggaaggaaaaagctcttcacctccttgactcttacagcatggtgccctcatccaagctcctgtttgaaaagcttcagagaacaatcttgactggcctttttctagtcatgttctcatcctatttaccaattacagagttaggaatgtgagatactatgatggttccagcttggagctcttgctatgtggcctctgaagccagcatgctgtaactggtagctctgcctagatccatgtgcttggtgttagggaaggaacagtttctctgccaaaagggaataaatactttgatcagaggtagaggaggaggggaacaggctgataaaaacactgaactgcattatctaccttgtgtgcctatactaataaaggtttccttaatgtcacattgatatgatcaaagcaagaaactaaaattatgaacaagatactgactatgtcttttatgactcattagttcagaattagaacctgggctctggaaaaaaaataacacagccatttcattgtaaatttgtaaactttgcagcagtttaaccatgagagttggcatataggtcagggaataggcctggtgggttttgctgtcaaatcccattatactcctgcagagaataaagtgctttgtgcttcgtgaaaattggtttgtagtatgtgtgtaccaattatcaggattgtcagaaatgttggccaatttcctttcaggttcatagggacttaaatctgaaatacttctctacaaaaactttacttagctgcataattctgaaatagctttattctggccaactgcttatttataacagccttttcaggtaatattctaggagttatttctcaagatttattccctttatttttcttgatattctttcaggtgcaaggaaataaaaaataatttggcttatgtatacaatttggataattttgtagtttttcttacactgtgttgctcatttatgagaaataggcaaatagataaagaaaattcggttactgcatgaagtactgaaaaaatgtaaaaaaaattccttggggaagtcatattttagtccacgttctgttgttaattttaatcttggggttaagtaatttttgctcttggtatgagattataaacaaacaatccaattgacttgcctttcaactctgaacagtttcttgatcacagtgtaaatagctgcttgaatttcactgctgttacatagcttttcagatagtcaaggaaatatgattctgccatattcatgccagcagattccaaagggcaaggaaagatgtttcaacagatcaggagtctaaatgagttacacgttgagcaattggccagtgaagagccaccaacagtaactgggcagccccaggcctgtaggagcatctgaatggttctagttcccaggaagagcttccaaagaacacatggtcttacatagatattttcaaatagctgttttcctcccaattattttagtaaacctatgattgttgtagataaattagaaaagtaaatataaacaggaaaataaacttatgcattattccataatctgaagatgcctttgataacattttggtgtatagctcatcattttttcttatgcatatatattttaaaatccatttagattatgctgaatatataattcctataatatatgttctgtggtaatttagaataaaaatcccttcggtatgtgaatttaaaacaaattataggcatataatcattgtgaagtatctattcttcaaatcacttttttgttctttttagttatacaaatgggaaacagtaaaatttgccttttatacttgagtccaatatatattatttgagcaatttctaaatctaagatactgtcataaatactttaggaaatagcgaaacaacattaataagacataacatttgccctcagggcatttatatagggatacgcataagcaatcattagatgaatcagataatgtttcatgataaaatggaaaccaaataaatttataaacgatcatagaccttagatagcatggtcccaatctgggagattacaaggaatattttgttggatcttgacgtattggccaggatctcagccagcagatgatggtggtgggtgatggttgagggagggatgctgtggaatgaaggaataacattcaggatggcatagcatgaacaaaaccaggaagtgaaaataaatgcaaagatgctcttaagtcactgtgagttctctgctgaagcggaagaaaacactggtaaattaagttgacaatactctgagaacgaatttcagttccagacttagtttaaactttatcctgtaggcagtgcagagacacagatgcttttgagcaagtccgtaaaatggtcaaggctgtaccttaagaatatctcatggaaacttaaattcctagaaggaatgacaaaaccattttttgtgtaggtaagtgttcatataactgttctctaaacatctcatatttattttttaatataagttatagatacagttttatttttacttttgtaccccaagaataccttcttagaacttcttagaaaagcataaggatatcctgaagtattttaatgtctaaactttcttgttattagtatttgtttttctcaatttatggcttgacaatagagtgttcgtttgttctgtatgtatttgttcctcttgtctttctttcatagaatgcccctttcattcaaaaagcattaatggagcaactatatgagtagactatcgtattgtataatgagcactataaaaactgtgtgtcctggagaatttgggttaaattatctggctgggcctggagatagcactttagtaagatacattttgaatatcatgaaatttaaagaaaaaattgctagcacttaagatagtcaacttggttagttgatatcaattatcctgttaattaaggattttgaaactcagattctcctgatttgttgttcaatttcctttctaaaattttaaagtacttttcttttattgcttattagctatttggtttaactttaaattgctaaaactttttgaagaatgaaatgtattttacagttaccatttgcatttaatgtgtaaaattgattttaggctttcattaagtcaacttttatactcaaggtttagaattttccttgattacaggtggctcacacctgtaatctcagcactttgggaggctgaggcaggcggatcacaaggtcaggagattgagaccatcctggctaacatggtgaaaccctgtctctactaaaaatacaaaaaaattagccggattagcccggcgtggtggcacacacctgtaatcccagctacttgggaggctgaggcaggagaatcacttgaacccaggaggtggaggttgcagtgagccgagatcactccactgcactccagcctgggcgaaagagcgagactccgtctcaaaaaaaaacaaaccaaaccaaaccaaaccaaaaaaaactactttccattgctaaatgtgtttccggctcaagcagagatactggttgccatttactcaaataagcaagcctactaattatctgcaaatggcatgtcaagtgacccccaaaattaaacatctttatgtaaaaggttttctcttctaatgtttactttggtctcagaatccattatttaattaaacagttatattgtttatccagctaatgcaactcagtgcgtaagaaggcatttacttaaatctaagaatatacttgaatttttattgctattaattgtattggtgaattcttttgtaccatagcacctttcaagtttgaaaatgcagctcttttgctgttagatgtaagtgcctctgtacccatttcataaagactcatcacctattctgagaccttgattttgccaccccatcacccttttcccttccaaaggcaaggacaaaccagagcaattgtagcaacacgaaatcgcaaaagaaagacaaagcttcatggttctctttacaccataataaccgagcagtctcaaatctctcattaaattttagtgtttcgagtaatctcccatggtttttagatggtaatagtaatgtccttttacctctaccagtttgttccagacttctttgatattacaaatgggatacggtgtataaagctggtcaaagtcaagaaaactttggtaaatactcctgtaactatagatactggtggttcctgcagggtattggtattccagacctgaaagattcatacacaatcaatctgaaagtcagagcagagcaaatgcaccataagctgtgaagttacttagtggttctttgactgcttaactgagctggtgaaagtcagggcctgtgtatatatgtttaagtgataatctgcatcagttaattttcctgtttcagatttgccagttcaccctgaccatcttgaaaataagttatctctgatctctgtctgtatgttacttctctcccctcaccaacggagaacaaatgtgggcaaagtaagtaaagcaatcaccacctttggagggaagaattggtcatgttctatggatggtggatcaactctattgcggatactcagtaacatttttactctctaactcatcatttacacctcaaatcttttttatttaaatgctctgaagttgtagctttgaataatagtcttcgatgtggtaggggccttaatcaccatcattctagtctaactcgtctcccatcaaatcccatcctatgacattcctgatgaacataatttagcctctatttaaaaatatctatgatgaagagtgcattgtcttaccagaaagcccattccacttccaattgttgtgagagttagaaagttattcctcagttttggtttaaacctggctccctcttcattccacacattgacattagttcagtttacaggagctacatagaatagtctaccatattttcctcatgactgtctttccaatatgtgaagtgaactataattcttgccttcctcctaaatgtagttttctccaatttcatttggtatgcctattaaaatgcagagtcctgtttctccagaggtttttgttgattaggtttctggtaggcctaggatttctgtctgttttgtagtgtgatctgtgtttacatccgagtagttttatcaggctgtttcttgtctgtggaattttggaggtccaatagctttcttttgtcttgtactctatcctttaaatttcaaagtggcagtgtttccactggtttaaaattctcaagaatcttgtagttttcctgtgtatattagagaaattcactcctgaagaaaagaagcttgtttatagatttttcttagataatcttgtctctattttgggggtctgctgagaaggccgagggggtccatgagtcacctgtttaatctctttaaagagccttttgtgtgactgaatactgatttttatctttctgaggtaatagcaaaagtgttaccagccacacttctggctttttctctacaatgcacttttctggcagcgaatccttaatttttgctgataacattttaagtcatcaagtcctggccacttttggtttcaccgttctttccctaatttttatctttccttttacatcttactataagcagcgagaaaccaaaatgtgccttcaacactgcttgaaaatctcctcagctatatgcccaacttcattgtttacaaattctgctttccacataactgcaggacacaattctgccaagctttctatcactatgtaacaagtatcacccttcctccagtttccaataacacctttctcatttccacctgagtcctcactagcagccagcttttttcttttttctttttctcttttctttctttctttctttttctttctttctttctttctttctttctttctttctttctttctctctttctctgtttctttctttctctttcttctttcttctttttcttttctttttctctctctctttccttccttccttctttcttctttctttctctttctttctctttcttcttttcttttctttctttctctctctccttccttccttccttccttctctccttccttccatcctctgtgtctctctctccttccttccttccttccttccttccttccttccttccttcctttccttccttccttccttccgggtctcattttgtcacccagcctggagtgcagtggtgtgatctcagcctactgcaacctccacctcccaggctcaagaaattcccccacctcagtctcccaagtagctgggactacaggtgcacaccaccacaccctgctaatttttgtattttcagtagagactgggttttgccatgttgcccatgctggtctcaaacccctgggctcaagtgatccacctgcctgagcttcctaaaatgctgggatcacaggtgtgagccactgtgcctggtctccagcagccactttcatgtccgtatttctatcaatagcctgttaataatgatttaggtattctctagggtaatatatatttttctctaccttgcttctcacttccttctgaagaagcagagttgttaacatccatatttctactaaaagtctgtttaagatagccttctaactttctaacttagcagacttttagtagaaatatggattctaacaactctacttcctcagaaggaagtgagaaggtcttgatctgtcgcccaggctagaagtacagtggtgtgatcacagctcactgcagccttgacttttgagtttgagcaatcctcacacctcagcctcccaaatagctaaaattacaggtctgccccaccaagcctggctaatttacaaaaaaaaatgttttttttgttttgttttgtttttgttttttgagatggagtctcgctctgttgcccaggctggagtgagtggcatgatctcagctcactgcaacctccacctcctgggttcatgccattctcctgcctcagcctcccaagtagctgggactacaggggcctgccaccacgcccggctaattttttgtattttaagtagagacggggtttcaccgtgttagccagaatggtctcgatctcctgacctcgtgatctgccagccttggcctcccaaagtgctgagattacaggcatgagccacagcacctggccaaaaaaatgttttttaaatatagggtcttgctatgatgcccaggctggtcttgaactcctaggccttaagtgatgctcctgccttggactcccaaagtgttgggattacaggagtgagccaccatgcctggacttaaccggtttgcccagagaatacccaccagtggcgtctgtagctgtagcatttaccccaagataactttgccaagaaatatgcttttattattattttcgcatccctctggtatattgacttcagaaacaaaagacatcactctattgatcacattctgtttttagtagtgatatttccatttacaaaatatagtaattctcaatccctgaaaatgtcaaatcctagaaaatgtggcattcctatgaatgatgttaacatcattattgaagagttgtttgccaagaccagctcggctggggagaccctaacccagcggcgctagaagaattaaagacacacacacagaaatattgcatgtggagtggaaaatcaggggtctcagccttcagagctgagaacctcgaacagagatttacccacatacttattgacagcaagccagtgataagcattgtttctatagattatagattaactaaaagcatttcttatgggaaataaagggattggctgaagtaaagggatgggttgggctagttatctgcagcatgaatatgtccttaaggcacagatcgctcatgctattgcttgtggtttaagaacgcctttaagtggtttttggccctgggtgggccaggtgttccttgctctcattccggtaaacccacaaccttcagcatgggtgtcatggctatcacaaacatgtcacagtgctgcagagattttgcttatggccagttttggggccagtttatggccagatttgggggcctgttcccaacagttgttggccaaagattcatttgattaacctgatttttccgtaacagacgattccgatgattctggtgttagctctgtttagaaataactccaagaacagtttttatattttattttcacattgaaaatcagtcagatttgcttcagcctcaaagaatgtgtctaatgaaaattaaatgagcgctggcagtgagctgcacttttctttttctaaatggaaaaagggttaaggccttttgtctgatcgaaaacccttaaaacagccatctgactcaaaggcctgacagaaccaggcccaccatgattatctaggataatctcttgcatgtacagtcaactgattatggactttaatgacatctagcgactcctggattagtgtttgattatgtaattggggactgcagcctagccatactgatacatcaaaaagactgtcacggtgtcttctatcacttattccattaaccaaagctgccacctcacataacacaataatttattttcacttgaacatttaggttttaaagggacttattctcagagacatgttaggaatcaaaatagaaatagttccatatcattggctcattgaacacaatagttcttgaattagcagttacaacttacaagttgtaaattgtttttccatgaggacttaaaagtttcatgtacattaaatataaatttcttttggctggaaatggcattggtactatttaaatagtctattgctggctgggcacggtggctcacacctgtaatcccagcactttgggaggttgaggcgggcggatcaattgacgtcaggagtttgagaccagcctggtcaacattgtgaaaccccgtctctactaaaaatacaaaaattacgtgggtgtagtggtggacacctgtaatcccagctactcggaaggcttttatatgcatttttgaatgcaaatttttaagatctgtgtggtaattagacatataatcatagttataattattattttatactgaaaaactttccaaaagacatttagggtatcatggccaaagcgagtcactgttttatttaaaactacagtcagttcaaccacaagcttttctgagtgtctattgtagtggatatatgtgcttttctttgtcaacttccccatcagtaaaagcaccctaattttattttggggttccactttctccctgccctcagtaatttggttaggttaagactcaccctcctcatatcccccattttccaggtttacttggaaaatagtttccaggtttaccattttcccatttacttgggcagtcatcatattccaactctctggccacacgactggtgcggggatgggcctgtaacccatgtaagtcaatgaataagacccagcttggtagttattaagatataggttgattgcttaaaattgtaagagtggaagagtaagaaggaaagtcaaagagaaaacagttgagccggaaagaaaacggagtcattcaaatcattattcgtaaagagtttcaagaagtggcgtatcaatattctcaacttaatagttgggcaatatttatgtttttgaaactaacaactaaaatacttggataaaatatttctcctgatttaagtaactataatttcagtcatgattcattgttcccagcaggatctgtatctgtgtaagtgggcatagtattgattttttttcaaaagagaagataggtgatctcattaatttccttttcacatcaaagctttccttttagggttttttttttttccttctctcaaaaaaaatactgaatgagtcagggtgctaatctgctttgctctagtaaattctatcttctcattgtagagatgtttttcaccgtagtaataatttgcttagctgcttggtatttactcatgtattcattcacagttctttatcaggcttcaggtatgtacccaatattgtgccaggtgaaatgagattcaaaggtgtctcctagcctagaatgtaaattctataaggaccttctcactcggagcacagtattggcacattatcagaaatctatacagatgcatttaggatgcatttctgtaacaatggtcacttgtgaggtgccatgcttgaccttcaagtattgcctgaaactcaaacacaagttgagggtttgagcctttgtacttgtttcctacagggcagttattcttcaaaatgcccaggtttaatgatacttatttttattttttattatttatttacttttttgagacggagtctcactgtcaccaaggctggagtgcagtggtgtgatctcggttcaatgcaacctctgcctcctggattcaaccgattctcttgcctcaggcccccaagtagctgagattacaggtgtgcaccaccacacccagctaatttttgtatttttaatggagatggggtttcaccatgttggtcaggctggtcttgaactcctgggctcaagtagtctgcccacttcagtctcccaaagtgctgggattacaggcatgagccaccatgcccggcgatacttatttttagtagttcacaatgaaataattaattatatttagtgccaatacaatttcaaataatgatgctggaatgacacccgataccacagtaggcaatgattttgatctctattagtttactagttatagtgggttaaatagtgacttcccaccaaaaatgcccacatcctaattcctgtaacctgtgaatgtgaccttatttggaaaaagggtctttgcagatgtaactacgttaagaatctcgagatgagaccatcctgaattatctggttggtccctaaatccaaagacaaatgtcctttacaacaaaaagaagagaagagggcacagacacagaggagaaggcaagtgaagatgaaggcagagactggagttacgtggccacaagccaaagaattcctgaagccaccagaggcaaggaaggattttctcatagagccttgggagccagtacacacctgctgacaccttgattttggaattttagtctccagagcagtgagagaatacatctctgtttgagcattaagtttgtggtaatttgttacagcagacctaggaaactaatatgttagttcgtactgattatttaattaaaggctctttttgtattgttttgttttctaaatagtctgcagaaacctacctcaatttttgtctccatccaatagagacacctgtctgtctgttgagatttggtggaaatccaagggttagtgtttctgggttatttttcgcctaccacagatagtgctgaaagcccatttagtacacaaatatgacacttctgaataaagtggcttcaacaactggtctggagatccaagtgctattcaaaaaagtgacactcgttctgagaggcgattcctatgaaggagaagctccatttgcgaagttatagcaaggttccttccataatgcacagcagctgggccagggagccgggagtcgtcgcttctggcctacccatctctgggctacttcccgcaactcactttccctgtgtgcctggaatgcttcttcctatgaggccgttagtcaaattaagtagaggcctttaaaaattagccatccatccaatctagagaatgtccactacgcttcattctttctcccttaccctgttgatttcttccatatcacccagcgctgatggtaattgtatgaatacatgcttatctgtctgtcctcccacccctaactctaaattcaaggaactctataactgcacctagcatattgtctgacactcctcaataaagacgcatttaatacatagacaaataatgagtgaacattttgagtggagggccggaaaatgtctatttactttggagttggaatcagactgttcaagagtactttcaaaaaaaattttgctacgtcaaacatcattgaatttcaggattgaaagagtggtggtcatatagctcaatcccctccaaacacccccacccaccagatgcgcgaatgccctcttcagccttcctgataagcatgacgaagatgctggcggaagcatccctggtatcaggaaactcatgacctcactagttttgatcttttccatttagctttcttttcccactcctcccagttattgcaaccttaattgtagcattttacacaactgctgctgcagagttctggaagtctgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttggaaactgaagggactgccacctaaaacagtaaaccctggggtcctgaagagaatttgctggttcgaatgacaagagaaaaaataattgttctgtagggatggtttagacctcagcttttgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctctggaattggaatcagaaaatctgagttttggtgtgatttccattttattacctatgacactgtggttcgtttaacctcagtgggcctcagtttcctcattttttcaagttggagggttggattaagataatttctgagggccttttgagaatatctaaggtatgccccagaataaaaaagtataattccttaactctctttaacttgttacaaacattgctagtttcataatttcatgaaataaaaacaatctgtattaatcttggcactagtttatatgcatttatgacttaggcttttaggattttcccaccaaaaggtatagagaaaaacatgtataaagagctcagaaacatatagatttatatgaatatttacacctctcatactaccttaaataatctttaagccagtatttgcaacactgcaacaaaaatacatggctttagcatagcacgtattctctttaagtattgtacatctggaggaaataaaaatgtgtttgaaggaaaacaaacattgcacctttcctatcaattattgttcttgaacagtgctggctactttttagcataaagttgtgggcagaatgttaaaaaattggtttcaggtcacttctgagccgctgtgaaattaagcacaatagcagagatgccaattttagtaatgcagttagttgccttggaatgaatcccagaaaatagcagagattaactaaacagataaaccagaaattaggaatggacacacgcacacacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatctgcttatagtttggaatattccttctcaaacatgttttttggagtcttgctatgttgcccaggctgatttaatactttttgtgacttaatagtgatattacctgttatcatcacacataatcttattaatatttaaaatattttaaaactacaaatcttatataaatataaataaaatctttaaaacatttgaactgtaatgaatatagagagaagcatataaaacaaatttaatggttgacagataatatgataaatcattataataattgtaaggcaaatttctcattattcaccacccccaaaaaaagaacattgcaaatatcccaaaacttcttgtttgttccttcttcatcacaaatctaatttacctttttttaaaaaaagaaagttatttacttatttattttgagacggtgtcttgctctgtcgcccaggttggagtgcaatggctcgatcccagctcactgcaacctccgcctcccaggttcaagcgattctcctgcctcagcctcccaagtatctgggattacaggcgtgtgcctccacacctggctattttttttttttttttgtatttttagtagagatggggtttcaccgtgttagccaggatggtctcaatctcctgacctcatgatctgcccacttcggcctcccaaagtgctgggattacaggtgtgagccatcatgcctggcccaaaaaaagttttatatgattatggtaggcattaaatcatagattattttgcttaacattatgtttatgagattaagggatttcttctctctcctttaaaacaatattttttgaaagagttatctcggctgggcatggtgcctcacgcctgtaatcctagcattttcggaggctgagacgggtggatcacaaggtcaggagttcaagaccagcttggccaagatggtgaaatcccatctctactaaaaatataaaaaaatttatccagacctggtggcaggcgcctgtaatcccagctactccggaggctgaggcagagaattgcttgaacctgggagacggaggttgcagtgagccaagatcgcaccactgcactccagcctgggagacgagtgagactctgtctcaaaaagaaaaagaaaggaaggaagggaggaagggagggagggagggagggagggaggattgtctctattccctgtctccaattattctcttcacactgttaaaaaaaactcattcctattaatcttgttttcaatattctgctaaaactacgtcaaggtctactactgtcaagttcaccaatgatactacctttgctcatccagtagtcagttgtcagtgttcattttacttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctactcaagatggagttgctctggttcagacgcctctgacagctcccaccctagtacaaggtgccatcaactctcacgtgagttattgcaaggacctccaaactggtctccctgcttttattttttgccctcttcaatacattctcaaaatagcaatcagagcactccttttataatgcatgtcggatcatgtcacttttctcctccaaactctccatggatttctggttcacacagagtaaaaaccaaagtccttaggataacctccaaggccctacctgatcattctgcttgccactttacctgtctggtctcatttcctactgttcttcctttcactttactcagttccagccacactgggctccttgctatttcttgactatattagaaaccatcttttcattttagcttttcctgccttgaatgcttgtcctccagatttccacatggttcgctttgttactgtcacttcttttaagtcttcgttcaaatgtctccttttcaatgaggcctactctgattacagtatttaaaattccatatcttcttaccttgtaatatattctttttcctttcctttcctttcctttcctcctttcctttcctttcctctcttctcctctcctctcctttgtgtctccctatagcattattttaccttataaaatactgtgtgactttctaattatcttttttttttctgtcccatttccactagaatgtgaactccacaagggcagaattttgtcctgttttgctcactgttgtgtccctagtgtgtgaaatagggcctaacatgtaagaggtgctcaatgctttttttggtgattgaatgctattgtttgttcatttttattcctggatatattcaattctataaatataacacgttaatttaaaacatgaattctgattatgcacatttagtttccttcctttcttcttccctcacccatcacttcttccttcctgccttcctcccttccttcttttttgccactataaataaagcagctatgatccatctacaagtgtgctagtatacgaagtttctttagagcgtaaaaccaatagacaaattacgggctagcaggacttgcagacttcaactttattagataatgaatgccacacatttttagtgtggattcaccaatttgcattcctgtttttattgctctacaccagatggacaaacttcgtattgccagaacatttaatttttcgccatctgatgggtattatctcattaatagttactactttaattactggtgagattaagcctggtgtctgtgaggataggttaggttatgctgcagtaacagataatcttcaaatctcatgggcttaatgcagttcttcactgatgcaaagtctcctatggactaagacaactctctggggcaacttctccatgtaataacttggaggtctaagttcagggaaactccatcattctgtaactgtaacaatctggaacatggaactttcccatttggtgtggtaggggaaaagacagcagggatggatactcgtgagccatcttcaaatgcttccatctgaaagtgacatgaattattttcaaatgctaaacgtaagtgtttaagatagtcatatggtaatatgacccagtaattctattcctaggcatatacctaagatggatgaaaatatacatccacacaaaaagttgtacagaagtgtcagtggcaacattcttcataataaccaaaaaacagaaactgcccaaatgtccatacactgatgaatggataaacaaactgaggtatatccatacaatggaatattattaggcaataaaagggaatgaagtgctgataaatgcttcaacacgatgatccttgaaaacatgatgctaacagaaggaagccagttactaaagaccccaggattttatttatatgaactgtccagaataggcaagtccataaacacagaaagcagatcagtggttgccggggatggaggaagctggtgaaaggggagcgactgctaatgaggaagaggtgcattgtggggtgatgataatattttgaaattagacagtggtgatgattgctctgttagatacattcactcaatgtactaaacctagtgaattgtatgctataaaagagtgaactttatgatatatgaataatagaccaataaaactgatattttaaaaaatactttaaaaataaagtatatttctatatgccatcaagaaacagaaaatgaaatattttagaaatgcatcatttaaaatgattccaaaaacatgaagttcctgtgaaaaacatctaacaagatgttcagggacttttatggaaaaaattagatgagatttacatctcatattagggaagaactcagtatatggagacagatagtcatacattttaggactgaatgattaaaggatatcaatttccttttcattgttatagactcaaaacagtctcaataggatctctattaaattcctaacaatttttttagaacttgacaagctgattctaagatgtatatggaaagtcaaaacccaaagaatgctaaagcactcttgaaaaagatgcaaaatgggagaatttgtgctatcggatagcaagactcgttttaaatctgtagtaatcaagacaatgtttctttattatttctttttcccttctactttctttgattttttctgttctaactgcttaagtgaatgttcgattaaatgttttattctaacagattataaaggaatgatagcacattaattttcagcctttcttctttttgaaaagtattatttatggctttgagctgccttctacatacttctttatctgtgtgaaataaattttgagatactgttttcactaagatcagtttaaaataggttctgattttcatatttctttttgcccagttattaacttaaaagtatttttctggttaattgaaactttagtcaatttggagtaagcttcttgatttctaatgtttctttttgcattaaagcctattttgtatgatattgatataactccaccagctttcttttgttccgtatgtgcatgttaaatcttttttccatcctttgctttcagatttctacatacttattttaaatgtgtctctgtatcctatatcatttttctgtcattctgcattcaacctttctatattcttatgttttagatgtgtctgtagtaaacagcatttatttcttaaggtattttaaattcaatgtctttccactggagaattttgtcagtttacatttaatacaattactgatatattgaggcttgtatttactttctgctttctttatttgcccataattctggttattttcttttttattgccacattttaggttgattatttttatcacttcaaattttctttcattactttaagagttatacactctatttctattgttcagtaactactgtggaagttaccatatgaatccttaagttatcgaagttgaaaatgaatacactttgagcactaatgagtacaggaaaatacagaggccttagcttactttaacttcatttaatactctcttgccatatattgtgagcatcttgaattccatttatttattcaaatatttattgagagcttactcggggctaagcattattctagatactgaacaaaatagatgagcatccctgtgcttgtaagacataacagagtgcaaacaataaacttaatagagtaaattataccatatactagaaggtagtaagtatatggaaaaaaaactagagcaaggcgaaagagattaggagtgccgagagagggagaaagagaatgaatgagagtgagtgcacataagtacaagtgaaagtgagtgagtgtgccctagctttggaccaatactgtctataaagtttgtggggacatataaatgttttatctattttcactagataacagctgaaaggtttgagccaaatagagagtctcaggtgcttctataatggtattataataggctttaaaaacgtgaaaaactcatgtttaagaacagctgttaccaactatctgttttgtgagggtggaggacaacttagtttttctcagaattaattatactttcttattgtaactttagccgctgttatttgggtctctaaacctatacaaattaagaagctatgaacatgagagaatcaaacaattagatttctgtgcacaccaacagaatttctgaaccaaagtggtttgtgtttaggagatgaaagagatgataaatcatacacacacacatagataaacacacatattatatgcatgtgtgtgcatgtgtgtgtgtgtataaacacagagagaaaacatactggcatacacataagcacctgttaattgtagttgctgttatagtagtaagatgttatctcttagaattatggtatacttatcatattagacctatccaggaggtagctgggtatctagtgtggtgatactatctagtgtggtgtcttgcaacaacactgctagtcataggtctgatttgggggagaaaatatttttttaagacagtgtctcgctctatcacccaggctgaagtgcagtggcatgatcatagctcattgcagcctcagtctctgggttcaagctaccctcctgcctcagtgtccccactgcatgctaccacacctggctaattttttcaaatttttagtagggacgaagtcttgctatgttacacagggtggtctcaaactcctgaactcaagtgatcctcccgctttggcctcccaaagcgcagggattacaggtgtggaccatcgtgccaggctgggagaaaagttttgttgacacaacaaacaggatgcaaagaaacaatctataaaaacagtaatttaggtaagtggcttcttggtcttttgattaataggattctaaacttgcaaatcaattcttatgcaggagttcttattggcatttaccgatgctctttggctgatgtttgtttttactgaccagaggttctgtgggaatctcatttattaatacttacaatgtgcttcatattcctctgcatctttgagggacaattaaatgtccactctatggaatcttttataatttcccaatcataagtaattactctgatttctcctaattacccttttttctaggtagttgtgattctttaagtctaagacagcatggatttttaagctacaccactgatatagtttggataatagtcccctccaaatctcatgttgaaacttgattcccagtgttagaggtgagtcctgaagtgggaggtgtttaggtcatggagcagatccccaaagagtggcttggtgacatcatcacagtaatgagcatgttcttactctattagttcctgtgagcactgatttttaaaaagagcttggcttgtccctcctctctcttgcttccatgctgtcactatgtgatctctgcatgctggcttcctttcccctctcctttgcctgcactatgagtggaagcaactcgaggccctcaccagatgcagtacaggtgccggtgccatgcttcttgtatcgcctgtggaaccatgagccaagaaaccttttttcttcataaattacccagtctcaggttttcctttgttacaacatgaatgaattaagataaccatcatttttgtatcagtaaaaagaaaaagctctgcgtatttaactattatacagtattttttatcatttaaaaatttatacttattcagatagctcactaagaattatatatataaacatttttatttaaatcatgccattctcataaggaaagtataaatcaaagatttcggttaagggattcttattcatattcaaagtctgtttttttcaagttgcttttcatctcagaactgttgatgtaaatattttcccaaacagtatcatactctgggctatcaagaatatttgtgatacagcaattcaaaaaagaatgcctcactattgtttctgggattttcttccaagctggttcattttgctaattttgatgcggcttttaactgatcttgtaagatgtcaatatcgggttttttggagttcatattctttcctcaaatggtctttaaatagtttgttgaccaaaatattgataggttaaaattgtccagttggtcattaagaaagtgtccagttttgatgtatgcaatcaataacaaccagatcacagctgctaccaggccatcgggaattgtaagatgctataaatttaaacaatgatgctgatgccagaggtgttaaaatgttgtgaatcttaaaacagaagacatacaatactactctcttcctttgtatttcctgtagttcaactaaaaatctcacctttcgttggcccctaggactttgtgagtagctattttctctgaaatcccatagtactttatttaatgaaaggaactaagtaataatttggggtgaaaataatccatgtacatggttaaaaaaaacttacttatgtataaaccagtagccctctgctctactacctacactaaagggtataacctgaccctaggaacaactagtttgaaccatttctggttttagtccttcttcctctagggctaaattgtatgtttatactgtctgcttttctttttttttcatttatcatttaagcagataccatagtagaagataatttagcctactcatttcacctccttttcttttttgctcctccacatatattaattttatgagctcctttattggttacatttgtcatttccaccacgatatttgttccattaactacagacagtttctcttgaacccctgcttcatgagtttgggatatttcaccctttctcctctcaccatctctccttgtatattataacacctaaatctgacaactgtgtggtgagagtattgataatattttaggtttagtatttgttattaaattttgtatttttgtctattggttgaccctaaaagttgaaaaattaataaatagcattaaagttattatgaccctgtaaatgttgtttactgcagaatcaagaagtattctacagttacatttcattcagtatggctcctgagccacccaaagaatgttcctagaatcaaagttaaggagattctttctttcaaatggattatttaattctagcatttgctaaaaatttgccatattttcttttcattcatatttacattgtgaatttctgtgacgctttttcaaattacctttattttttcttattgggaaagcatatgtgggccttcctggtttcatccttaataattttcagctttttactttctttatttttttgaatgcattttcttccttttttttttgaagtccactgactcatattctagtggcttcaattttgaattatgacttcctttttccctggtgtttattctgtttttattttattttcaagtttttttctggcttcaggattatattatgtgtcaggttgccttccatctccaccttcctccttgccatctccttttgggggccatctatactacagctgctatctggactagtcatttgaaagtttgcagagccagcaaacttgtttgtaaccacgatttcctgaatgtgtatgtttttgtcgtttttggttttctcctcattttgctggaatactttataaaattacttctggcaaataaatttatactatataaattttgtaagccattacattactaaaagtatatttgtttctctcggatacttctttgactggatgtaaaattctaaactgaaaagaattttctataagtcagttgctggattattttctagtattcggtgttttgggatgaaacatttgttttccattctctttcttactcctttagtgatttttttcttctctggaatcttttcttatattctttttttctttgttgtttggtaatttcttaattatatgtttaggaatgaatctgtttccattcttctttcttggagcctggtagccatatttttcactttgaacacttgtgccttttatctctgggaaatgtgccttttatctcttgtgccttttatctctggaaacacttgtgccttttatcgctgggaaattttcttgtattttttttgtgtgattattttctcctttctattctttttttctggaagtactgttggttggatttgggtctcttggatttatttttaagtgacttctttttcttaaacatttatttcctggttttttttttttgcctttggggggaaatgttaattatgcattttttttaaaaccattgaaattttttttttgtactatgcatgtaattttcaaaagctctttcttgctctcattattcctttgttattttatggatccaaaactttctgaaatgtctctgccaatactcattaaagatttgttaaagcttttttttttttctttaatttatccctgtgtccctggtggttagtttcctttttactttctttttataaaagaaaaatttaacacaatgctaaagactttcttcatgtctttgtgtctccattcagcatggctgttaaatgaagaaacaggaagaatgtgacttctgtgcatatgggcagtgttttatcaactgataggcttcatgttaggcactcaatcaaagagctgccatttatgctaaaggcctgttgcctaaatgtcagggctttaccataccggtgccaagtttacatgaaaagctcaagttctcaaacaacttgtactttttcctcctttaacacataggagtgtatactataatttttaaattgtctttggccatttgacacctttgaatactttgctcgtgtttgaggaatttccacttaataagcccctgttttcccaagcttcctggcagtctgcctgtagagtgtgaagtaggctccatcagttagaggcatttgtgccagattttagatcagaagtgtgggacatgaaagggcagatgagctccccggagctcagaggtagtaggcattgaggtttcagtcataacatgcagtatcctggtatggtgcagggctgtcttctctagagcaattctgcatgggattttgggtgtggtcttggctgtgtgcttttctagcttggttctctggcactcactgaggttcggagagctacccagtaaactttaataaatttctttcctgcttagactagtcaaagttcatttcagttgtttgttagtcactctcctgacagttacatggagctagtttagctgctgtgcaatgtttgtgaggaggtgaattacatacgcagatattacatgtgcagaccaaaatggcctctccttttagccccacctcaccctcctgcccttatcatttagaacatctgcaggtttgttttctcattgttgacagcctattctccaaatatcctatgtagttactacctttgttatacctcattagtctttgctaattgatatggtttggatatttgtcccctccaaatctcacgttgaaatgtaatctccagtgttggtggtggggcctggtgggagatatttgggtcatggggtgggtccctcacgaatggcttggtgccctccctgtggtaatgagtgagttcttgctctgagttcatgcaagatctggttgttaaaggagcctggcatcttcttccaccctctcttgctcccccttgccatgtgatgcacctgctccccattcactttccaccatgactgtaagcttcttgaggccctcaccagaagcagatgctggcctcatgcttcctttatagtctacaggaccatgaaccaaaataaaacacttttctttataaattacccagtctcagatattcctttttaacaatgcaagaatggactaacacactaatgttttagaaatttgtttttctcttttgctgctgatcgctctctcattcactcttgtagtgggttgatattatttactttactataattttcaaggtatctcaggagggaaagatcagtttgttcagtttaccatttttttttgagacagcatctcactctgtcacccaggctagagtacaatggtgcaattttggctcactgtaatctctgcctttcaggctcaagcgattctcatgcctcagcctcttgagtagctgggattacaggcatacgccaccatgcatggctaatttttatatttttagtagagatggggtttttccaggctggtctcgaactcctggcctcaagtgatccgcctgccttggggttccagagtgctgggattacaagcatgagccaccgtgcctagtcccagtttaccatcttgaacctgaagtcccactggtattatcgtgctttgacatgtaaaaaaattaataaaatgttatttcttaaagtaaataaattttaattattttctacatttctagcatcacatgtggtagcttgcattttattgaatatctggttaatatttaaatgagtcaatttatgtagagcttttagattacaccgtaggtaagatgcctactctgactcaactttgttgactttatggtacccacatctgtgaatcatagcttatccttatgcattttttaggaattaatatgtgacaagttcacacagagtaatatcaggaattaaagtacttgaaattatgttttccaagtgacaaatatttatgccaggatgttggaaggttttttttttaattaaaaaataatttaagtctttaacagctacttgatgggaataacatgaccaatttatattccaagtgaataaataaaagttaacatacttaaaatgacaaggctactggaaatagatcaggctatatttattttgttaaatttttgatacttgaagaaatagtgtttttcagttgcatttaaattaaatgtttaaatgcttatttaagtgagagatagacagatgcttctctaacaaaaagtaaaagcaaaaattagtggcatttggagctcattgagttaactcatcaaagcaacattattgtcagaattgcttttcttactcataaactttcctacacactcagagattttttgagatcaatggagcaagttgtaaataattttatttctgctcaaacactgattgagactgttctgttttatatttaagtagaatttgataggtaaaaataacacaaataatcctttacaatagaaattaaacagtctgatcttcctttgaaagcccaaattatgcttattcagtagaatatagatttggattttttcttcatagtaataactgaagagtaagcatgattaatatgcttactgtgctgggcatattatgcaaattaaattactgcttgcatacccatacatcatggatgtatcatttagatcagactgtggatttgtctttgtatactttatacagatttcttcaaatatttgtatatttcaacataggcttttttttcttttcatttctttctaaattcctaagggctgtttttctttttaaacgtgagaataaatatctacattaattatttattatatactttaattgattcaacaactatttatgagtacttacgatgttccagagaatatattaaaatacttgtttttcagaagtctaatatggatgagaaacattgtgcctattctttttttttttttaaattgtactttaagttctgtgatacatgtgcagaatgtgcaggtttgttacataggtatacacatgccacggtggtttgctgcacccatcaacccgtcacctacattagatatttctcctggtgctatccctcccctagccagccaccccccgacaggccctggtgtgtgatgtttctctccctgtgtccatgtgttctcattgttcaactcccacttgtgagtgagaacatgcagtgtttggttttctgttcctgtgttagtttgctgagaatgatggtttccagcttcattcatgtccctgcaaaggatatgaactcatccttttttatggctgcatagtattccatggtgtatatgtgccacattttctttatccagtctatcattgatggccatttgggttggttccaagtctttgctgttgtgaatagtgctgcaataaacatgtgtgcatgtgtctttatagtagaatgatttataatcctttgggtatatacccagtaatgggattgctgggtcaaatggtatttctggttctagatccctgaagaattgtcatactgtcttccacaatggttgaactaatttacactcccaccaacagtgtaaaagcgttcctatttctccgcatcctctccagcatcttttgtttcctgaatttttaatgatcgccattctaactgacatcagatggtatctcattgttgttttgatttgcatttctcaaatgaccagtgatgatgagcttttttttcatatgtttgttggacacataaatgtcttcttctgagtagtgtctgttcatatcctttgcccaccttttgatggggttgtttgtttttttcttataaatttgtttaagttctttgtagattctggatattagccctttgtcagatggttagattgcaaaaattttctcctattccgtaggttgcctgttcactgtgatgatagtttcttttgctgtgcagaagctgagctgtttagtttaattatatcccatttgtcaattttggcttttgttgccattgcttttgatgttttagtcatgaagactttgctcatgcctatgccctgaatggtgttgcctaggttttcttctagggcttttatgggtttaggtcttacatttaagtctttaatccatcttgagttaatttttgtataagttgtaaagaaggggtccagtctcagttttctgcatatggctagccagctttcccaacaccatttattaaatagggaatcctttccccattgcttgtttttgtcaggattgtcaaagatcagatggttgtagatgtgtggcattatttctgaggcctcttttggttccattggcctatatatctgttttggtacagtaccatgctgtcttggttactgtagccttgtagtatagtttgaagtcagttagtgtgatgcctccagttttgttctttttgcttaggattgtcttggctgtgcaggctctcttttggttccatatgaaatttaaagtagtttttaaaattctttaaagaaagtcaatggtggcttgatggggatagcactgaatctataaattactttgggcagtatagctgttttcacaatattgattcttcctatccatgtgcatggaatgtttttccatttgtttgtgtcctctcttatttccttgagaagtggtttgtagttttccttgaagaggtcattaggtattttattctctttgtagcaattgtgaatgggagttcactcatgatttggtgctctgtttgcctattattggtgtataggaatgcttgtgattttcacacattgattttgtatcctgagactttgctgaagttgcttatcagcttaaggagattttgggctgagacgatggggttttctaaatacacaatcatgtcctctgcaaacagagacaatttgatttcctctcttcctatttgaatacccttaatttctttctcttgcctgatttccctggctagaacttccaatactatgttgaacaggagtggtgagagagggcattcttgtcttgtgccagttttcaaagggaatgcttccagcttttgcccattcagtatgatattggctatgggtcataaatagctcttattatttttagatatgttccatcaatacctagtttattgagcgtttttagcatgaagcagtgttgaatattatcgaaggccttttctgcatctattgagacaatcatgcggtttttttttgcatataaatataatagaatattattcagccttaaaacggggtgaaattttgatacgtggtacaacattgataaactttattttattttattttatttattattattattatactttaagttttagggtacatgtgcacaatgtgcaggttagttacatatgtatacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatacacccagtaatgggatggcggggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctacataaatgtcttcttttgagaagtgtctgttcatatcctttgcccactttttgatggggttgtctgtcttcttcttgtaaattagtttgagttcattgtagattctggatattagccctttgtcagatgagtagtttgtgaaaattttctcccattttgtaggttgcctgttcactctgatggtagtttctttggctgtgcagaagctctttagtttaatgagatctcatttgtcaattttggcttttgttgccattgcttttggtgttttagacatgaagtccttgcccatgcctatgtcctgagtggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagtgttatttctgagggctctgttctattccattgatctatatctctgttttggtaccagtaccgtgctgttttggttactgtagccttgtagtatagtttgaagtcaggtagagtgatgcctccagctttgttcttttggcttaggattgacttggcgatgcgggctcttttttggttccatgtgaactttaaagtagttttttccaattctgtgaagaaagtcattggcagcttgatgcggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagctggattcctaagtattttattctctttgaagcaattttgaatgggagttcactcatgatttggctctctgtttgtctgttattggtgtataagaatgcttgcgatttttgtacattgattttgtatcctgagactttgccgaagttgcttatcagcttaaggagattttgggctgagacaatggggttttctagatatacaatcatgtcatctgcaaacagggacaatttgacttcctgttttcctagttgaataccctttatttccttctcctgcctaattgtcctggccagaacttccaacactatgttgaataggagtggtgagagagggcatccctgtcttgtgccagttttcaaagggaatgcttccagtttttgcccattcagtatgatattggctgtggatttgtcatagatagctcattattttgagatatgtcccatgaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggcggataagctttttgatgtgctgctggattcggtttgccagtattttattgaggatttttgcagcaatgttcttcaaggatattggtctaaaattctcttttttggttgtgtctctgcctggctttggtatcaggatgatgctggcctcataaaatgagttagggaggattccctctttttctattgattggagttgtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtgtcgaggaatttatccatttcttctagattttctagtttatttgcatagaggtgtttgtagtattctctgatggtagtttgtatttctgtgagatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttacatatttcttgccttctgctggcttttgaatgtgtttgctcttgcttttctagttcttttaattgtgatgttagggtgtcaattttggatctttcctgctttctcctgtgggcatttagtgctataaatttctctctacacactgctttgaatgtgtcccagagattctggtatgttgtgtctttgttctcgttggtttcaaagaacatctttatttctgccttcatttcgttatgtacccagtagtcattcaggagcaggttgttcagttaccatgtagttgagtgtctttgagagagtttctgaatcctcagttctagtttgactgcactgtggtctgagagacagtttgttataatttctgttcttttacatttgctgaggagagctttacttccaaccatgtggtcaattttggaataggtgtggtgtggtgctgaaaaaaatgtatattctgttgatttggggtggagagttctgtagatgtctattaggtctgcttggtgcagaggtgagttcaattcctgggtatccttgttaactttctctgtcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaaccccggtctttttttgttttccatttgcttggtagatcctcctccgtccttttattttgagcctatgtgtgtctctgcatgtgagatgggtttcctgaatacagcacactgatgggtcttgactctttatccaattttccagtctgtgtcttttaattggagcatttagtccatttacatttaaagttaatatcgttatgtgtgaatttggtcctgtcattatgatgttagctggttattttgttcattagttgatgcagtttcttcctagcctcgaaggtctttacaatttggcatgattttgcagtggctggtaccagttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgtgagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccaagttggtcactttcaggtacaccaatcagacgcagatttggtcttttcacatagtcccatatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctctatcagctcctttaagcacttctctgtattggttattctagttatacatttgtctaaatttttttcaaagttttcaacttctttgcctttggtttgaatttcctcctgtagctcggagtagtttgatcgtctgaagctttcttctctcacctcgtcaaagtcattctccatccagctttgttctgttgctggtgaggaactgcgttcctttggaggaggagaggcgctctgctttttagagtttccagtttttctgctctgttttttccccatctttgtggttttatctacttttggtctttgctgatggtgatgtacagattggtttttggtgtggatgtcctttctgtttgttagttttccttttaacagacaggaccctcagctgcaggtctgttggagtttgctagaggtccactccagaccctgtttgcctgggtatcagcagcagtgtctgcagaaccgcggattttcgtgaaccgcgaatgctgctgtctgatccttcctctggaagttttgtctcagaggagtacccggccgtgggaggtgtcggtctgcccctactggggggtgcctcccagttaggctgctcgggggtcaggggtcagggacccacttgaggaggcagtctgcccgttctcaggtctccagctgcgtgctgggagaaccactgctctcttcaacgctgtcagacaggaacatttaagtctgcagaggttactgctgtctttttgtttgtctgtgccctgcccccagaggtggagcctacagaggcaggcaggcctccttgagctgtggtgggctccacccagttcgagcttcctggctgttttgtttacctaagggagcctgggccatggcgggtgcccctgccccagcctcgctgccgccttgaagtttgatctcagactgctgtgctagcaatcagcgagactccgtgggcgtaggaccctccgaaccaagtgcgggctataattctcctggtgcgccctttcctaagcctgtcggaaaagctcagtattcaggtgggagtgacccgattttccaggtgccgtctgtcacctctttccttgaccgggaaagggaactccctgaccccttgcgcttcctgagtgaggcaatgccttgccctgctttggctcgcgcacagcgcgctgcacccactgtcctgcacccactgtctggcactccctagtgagatgaacccggtacctcagatggaaatgcagaaatcacccgtcttctgcgtggctcacactgggagctgtagaccagagctgttcctattcggccaccttggctcctccccccatcatgtggtttttgtcattggttctgtttatgtgatagattatgtttattgatttgtgtatgttgaagcagccttgcatcctagagatgaagccgacttcatcgtggtggatgagctttttgatgtgctgctggattctttttgccagtattttattgaggatctttgcaccaatgttcatcagggatattggcctgaaattttctttttttgttttgtctatgccaggttttagtatcaggatgatgcgggcctcataaacgagttatggaggaatccctcttttcctgttgtttagaataatttcagaaggaatggtaccagctcctctttgtacctctggtagaattcggctgtgaatctgtctggtcctgggccttttttggttggtaggctattaattactggctcaatttcagaccctgtttttggtctattcagggatttgacttcttcctagtcttgggaggtgtatgggtctaggaatttatccatttcttctagattttctagtttatttgcatagaggtgtttatagtattttctggtggtagtttgtatttctgtgggatcagtggtgatataccctttatcattttttattgtgtctatttgattcttctctcttttcttctttattagtctggctagtggtctattttgttgatcttttcaaaaatccagctcctggattcactgagtttttgaagggtttttcgtgtctctatctccttcagttctgccctgatcttagttatttcttgtcttctgctagcttttgaatttgtctgctcttgcttctctagttcttttaattgtgatgatagggtgtcaattttagatctttcctgctttctcttgtgggcatttagtgctataaatttccctctaaacaccgctttatatatgtcccagagattctggtacgttgtgtctttgttctcactggtttcaaagaacatctttatttctgcattaatttcattatttacccagtagtcattcaggagcaggttgttcagtttccatgcagttgtgcagttctgagtgagtttcttaatcctcagttataatttgattacactgtggtctgagagacagtttgttatgatttctgttcttttgcatttgctgaggagtgttttacttccaattatgtggtcaattttagaataagcgcgatgtggtgctgagaagaatgtatattctgttgatttggggtggagagttctgtagatgcctattaggtcttcttggtccagagctgagttcaagtcctgaatatgcttgttaattttctttcttgttgatctgtctaacattgacagtggggtgctaaagtttcccactattatcatgtggcagtttaagtctctttgtaggtcattaagaacttgctttatgagtctgggtgctcctgtattgggtgcatatatttaggatagttagctcttcttgttgcattgatccctttaccattatgtcatgctcttttttgtcttttttggtctttgttggtttaaagtctgttttatcggagactaggattgcaacccctgctttttcttttttgctttccatttgcttgataaatattcctccatccctttattttgagcctatgtgtctcacatgcaaaggcatgtgagactggtctcctgaatacagcacactgatgggtcgtgactgtttttccaatttggcagtctgtgtcttttaattggggcatttagcccatttacatttaaagttaatattgttatgtgtgaatttgatcctgtcattatgatgctagctggttgttttgcccattagttgatgcagtttcttcatagtgttgatggtctttactatttggtatgtttttacagtggctggtactggtttttcctttccatgtttagtgcttccttcaggagctcttttaaggcaggcctggtggtgacagaatctctcagcatttgcttgtctgtaaaggattttatttctccttcacttatgaagcttaatttggctggatatgaaatcctgggttgaaagttcttttctttaagaatgttgaatattggcccccactctcttctggcttgtagagtttctgcagacatatccactgttagtctgatgggcttccctttgtgggtaacttgacctttctctctggctgcccttgacgttttttccttcatttcaaccttggtgaatttgacgattatatgtcttcaggttgctcttctcgaggagtatctttgtggtgttctcgtatttcttgaatttgaatgttggcctgtcttactaggttggggaagttctcctggataatatcctgcagagtgttttccaacttggttctgttctccccatcactttcaggtacaccaatcaaacataggtttggtcttttcacatagtcccatatttcttggaggcttagttcatttctttgcattctttttttttaatcttgtcttcatgctttatttcattaagttgatcttcaatctctgacatcctttcttccgcttgttcaatttggctattgatacctgtgtatgctttacaaagttctcatgctgtgtttttcagctccatcaggtcatttatgttcttctatatactggtttttctagttcgcaattcctctaaccttttttcaacattcttagcttccttgcattgggttagaacatgcttctttagctcaaaggagtttgttattacccaccttctgaagcctacttctgtcaattcatcaaactcattctgttcccttcctggtgaggagttgtgatcctttaaatgagaagcggcattctggtttttggaattttaagcctctttgtgctcgtttttcctcatcttcatggatttatctaactttggtctttgatgttggtgacctttgaatggcgtttttctgtggaatcctttttgctgatgttgatgctattcctttctgtgtgttagttttccttctaccagtcaggcccttctgctgcaggtctgatggagtttgcttgaggttcactccagaccctgtttgcctgggtatcaccagcggaggctgcagaccagcaaagattcctgcctgttcctttctctggcagcttcgtcccagaggggtacccaccagatgccagctggagctctcctgtatgaggtgtctgttgacccctgctgggaggtgtctctcagtcaagaggcagggtggttaggaacccatttgaggaggcagcctgtcctttagtaaagctgaagcgctgtgctgggggatccactgctctcttcagagccatcaggcaggaatgtttaagtctgctgaagctgtgtccacagccacattcttcccccagggagaatgctgtgtcccagggagatgggagttttatctataagcccctgactggggctgctgcctttctttcagagatgccctgcccagagaggaggaatctagagaggcagtctggctacagaggctttgtgtgcagcagtgggctccacccagttcaaacttcccagagaccttgtttacactgtgaggggaaaactgcctattcaagcctcagtaatgacggacattccttcccccaccaagcttgagtgtcccaggtcgatttctgctgtgctggcagggagaatttcaagccagtggatcttagcttgctgggctccatgggggtggtatccgctgagctagaccatttgactccctggcttcagcctttccggggaagtgaacggttctgtctgtcttgctggcattccaggcactgctggggtatgaaaaaaaaaactcctgcaactagtttggtgtctgcccaaatggctgaccacttttgtgcttgaaacccagggccctggtggtgtaggcacccgagggaatctcctggtctgtgggttgggaaggccatgggaaaagcataatatctgggccagagtgcactgtccctcacggcacagtccttcatggcttcccttggctaggggagggagtttcttgatcccttgcacttcctggatgagccaacgccccatcctgcttcagctcaccctccgtgggcggcacccactgtctaaccagtaggaatgagatgagccgggtacctcagttggaaatgcagaaatcacctgcctcctgcgttgatctccctgggagctacagaccagagctgttcctattcagccatcttgccagccacccccgcctgttctttttttgtgttcttcttgctaaatttatttagcatgagaacagcaatagcatgttctcacataagaagctgactaacagaatgcacagcatataaaaaatgtgctatttgtatagaaataatttgtcaacttcagcaatcagtttgagacccacatatcacctggatgaatggttctcctgcagaatctgattcagaggaaagagtcatgtggtgcggtgacttgaaagagctgtggtgaataattgaattctaagaatggccacagtagactccctgttaatatttctgaaaagtagggttatggagcacatattattaaactgttatttttaatagacatcttatacttgtatctggtctgtaagaccagtcatattagtgtacatttttcaattagtttactttggaagtgggcacaggggtctacactgctcaaatctgtaattataattaccttatgataatttattatggcaataatgggaatttgcttatttttctttgaaaaatgttttcaagctatacttgtttctgccatgatagagaacttttgcaacattcatttttgttgtgagagtagagccacaatgattttctaatgagaattgattaagccctttccttaccctagcccagttctaagtattgtcagtggtgattgggatagagggtagtctgtttggcatgtttccatgtcatgtgaggatgtcaaccctccgtctttttgaatgactgctaaggcacattactccttttaactgtcaacagagaatgactactactgtggtctgaatgtttgtgccaccacagaattcatatgttgaaacctaattaccaatgcaatagcattaagaggtggggcctttaggaggttattaggtcatgagggtggagccctcatgaatgggattagtgcccttataaaagaggctgcagcggagcttgttcaccccttctgccatgtgaagacatggcaagaaggcaccatctatgagaagtagtccttcaccagagattgaatctgctggcatgttgatcttggactttccagcctccagaattgtgagcaatacatttcctttctttataagccactgagttcgtggtattttgttatagcagcccaaatgaatgaagaaaactgcattccaggggaatgttaggcagtattatctcacctcttcatagtgtgatgtctgtgactggctcagttcatgcagctctacttgtggaatgtgcattacatttatttatctatatcaggaattcttaatcctggagaaatttcaagggattgttaaccccttgaaattatagccctaattttagttgtatgtgcttcctcatggcgttgatacacttctttcaccaaattctcagtcaggtccatgttccaaaaaatggttaagaatcaccattttgaaatccttcttgctattatgccagattctcaaacagctgtatctggatgataggagaatgcctctttgaaggttgcttttgtgcatgttggcatgggggaggtgctaaaatttcagatgggatggccagggcaggctcctttagaaggtgagttgagtggtggggagagcagtggatgacgagtgggatctgggaccttgtagtcctgttcaggacttggacttttactacaagtgacaggagagggctgtagtgctttgagaaagagagacatgatctggtcaatgtgttaataagatcactgtgactactgtgttagagagacatgatctgatctgtgttaagaagatcactttaactgctatgttgataactgactgaactggggagcaaggacagaagtagagagcctcttctgatagttccgggaagaaataattgtggcatagaacagggtattggtagtggagagggtgacaaattattaaattttgaaattgctttgaaactctggtattattaggatgttcatgaggatgttagctgttattttataaaattaatcaataattttcttagtgttaggattatttgtactcttctcctaaactgttcatttcattttaactactcagaatttataattgaacaatacaaccataagaaaagttagaacaaattaatggttcatccttaggaagtgtcttcatattaatggtgtttggtgtattaggcttattttggtcatcctatctttaattttccctttgcttcattcttttttcaccaatttaaaaaatttctgtcactttttctgtcttttatttagacagagtctcactttgtcatccaggctggagtgcagtggtgtgatctcagctcactgcaaccttcacctcccgggttcaagtgattctcttgcttcagcctcccaagtagctgggattacaggaacacgccaccacacccagctactttttgtatttttagtagagacagtgtttcactatgttggccaggctggtcttgaactcccgacctcaagtgatccacccgccttggcctcccaaagtgctgggattgcaggtttgagccactgcacccagcctctttttctgtattatttgtgttttaaaaaacttctttatattcctttttgtacagtttagggtgcatgtttctctcattgaatctatgtcagataccacctttcactgtctcttcaaggttgtgtctatgtcctttttacacttgtgattgtttctctgttatttaagaatgaaacctgattccacgaatccaaaccatcagaatagtttgtgttttgcatggaacattaaataaagaagtggttgttttatgtaaggaaaactgctgatctatttgatcacttaactgaggagaccaggtgagttaaaaacaagccaaatcatttgttgaactgaattactatagtcactagtaagtttcatcaaagcaatccagtgatatgttgtatctgtgacacatcttgactataaaacttgcccttgagtttattttatgagaacatcttatatcaagaacaggtagcataaaaagcagggaggaatttgtactcatttaatataattaaatcatgagggttccaaacagtgtactgatttctagaaatcctaaagaaccattgtgatatcagtgtataaagaacaaaaattctgatgacaaacttgtagtgtgaaaaacaaatttactggactacccactgtttatactcatttattttcttcctgatagtaagttgtaaaataaacaaacacttttttccatttacttatcatgtggtgccaattctcacttatcatatggtgccaattctcagatatgagtcatgagacatgtttcttaatgtttttttttttttttgaatcagaagtttttttttttgttttttttttgtttttttttttttttatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtgtaaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtacagtttgaagtcaggtagtgtaatgcctccagctttgttcttttggcttaggattgacttggtgatgcgggctcttttttggttccatatgaacttgaaagtagttttttccaattctgtgaagaaagtcattggtagcttgatggggatggcattgaatctgtaaatgaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttactggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttacatatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctatctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacctatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcctttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagttttttccaacttggttccattctccccatcactttcaggtacaccaatcagacgtagatttggtcttttcacatagtcccatatttcttggaggctttgctcatttctttttattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagggtgctcctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccgctgctttgtttacctgatcaagcctgggcaatggtgggcgcccctcccccagcctcgctgccgccttgcagtttgatctcagactgctgtgctagcaatcagcgagattccgtgggcgtaggaccctccgagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccg

SEQ ID NO: 581 - DNA, 118261 bp, Homo sapiens
ggggttgatagtcttgtgtatgagaggttgatccatataattaattagtggaaccagactctcaaacaatttcccacttcctctgagtagcctttattatccccaatggactgaatttcaaatctctctgccatgcccctacagcatctgagttacctcagcacccaccatactatcccagcaatttcttgctaaattgtaccactctccttgttgactgcaagttccatgagggcaggaattatgcctgtcctgttaccattccatacccaggacatagaccatagtaacagctccccacacattcatgaaatgaatgagtgtgctttgtgagctataaagaactttgtgatatagaaggcaggctgggtggcatgggggaatgaacaggataaagactctccaagtaccttttccctttggaagtctttgactttagaaacctttcacccagaaagcagctggagtgacagaaatattttctgagcccctaatatcagttccagatgtttgcaatcatgtgggtttatacctcaccctgtaaaacatattcccctcacccccaccccccaattctagctgagagagtaaagcctagtttccaatgacatcacctctctcaggctgacccggagtaagcagagagcaggcgggtgaggtcccctctagtttctcagatgaacagcatggttcagccatggcccacactgcatgaggaactaagagtaaattccacaagatttcataaatacctacaatgtaagtgctccatcacagccactgctgccaccatcctctcagctactggagaaaagagaccttgctgtccttcaccttgagttattcctcatacaaattcacctccataactgctcccttttactagagaaaattttcagtctaaggtctgagatgggatggtgtgtgtgttgggatgaggagtgtcttttcagttgtagattatccttaatgataacagggacagagaaagaacaggggaactgagagtggatacagatggcctctggacattctcctttacctggatgtaagtctaaatcagcagctcatatcagagccagcttagagagacaaagacaagcaaaggtcagctgagacatgggcacagagtgacatggaataaaaagaagagagagagagagacagagagccaccaagggaagccgacacacataaaggtagaaaaagaagaaaagaaggaaggagagaggaaaggaaataatcaggaaaggatataggaagaaagaaacagagacaagagttgagagttggcaggaagcaagagtgatactgatcgggggggagaggcccagtaggctcccagatgccagggcagaaaaggggcactgaccagctccagatgttgctgccttgtatgaggaggtgccggggctagtggatagggcctgctgcctctgtgagtgccaacagagccagatggccttccagccctgaactaaacaagctgaagctgagaatcccatgaagaaaaagagaagtttctgatttttttaaagttaaaaaaaaaatccagcaggagagcagaagatgaccaaagaaaatgcatgggggtgtggtgagaatatcaccagacagaaaaacaggagattatgatgctaggtgtgacctatcccttcttgtcctcactcttctgatccttacactgagggtggcggtttcaatgcttaaggttcttctacttggaactttagggattcacagaagctagtttatcagacaaagaagtgggaagcctgatgggctacaatcccctttacaagatcagagctcactagttgctcactagttgctgtcagtggctagatactccattctgtcaagccacacaagtgtcctatatccctttatttccatctgcctctaggtctattctcaacaagagcaaactacactggaggtaatatgaactagtgaaaaatctttgaatgtagtggatgagggtgtgggagtagataggaaagaaaccagagccctagttctagctctggctgtaccagtaactcaccatgtgtgtaagctctggacaagtccatctcctctgagcctttttcttcgtaggtcaaacaggagatttggatttattaaatctgcctgtgcctcggcccagcttcttactcccacatctaccctgcccaagaggctgaaacccatgccaattgttctgatgaggccatgagggagaaccagacgtctgtttttaatactgatgacagattagcgtgcggggcattcagccaccccccacaacaagccccatttctgctcaaaacaactggaacaggagactacttatgcttggctttcctaacagcgtcccggaactgaccgagcgatggcttctctgaaggagacaaagagggcgccaaacctagaggtgggggcaggggtaggagacagggagggagagtgagcatttcaaaagttagttcagaagggtgtgaaacagatggcagccataaagtgtgtgtgtatgtgtgtgtttgtgttcatgtgtgcacatgggagaaagagagagagagagatctgtgtaagcacctatgcctgtgcacatgcacgcatgagctcgtggataaataaataattccagcactggacttggctgccagcaaaaattcagagagatcaaaggataaagcctatgtttccctattctggcctcacctgaccaaatgtgtgagtaatcctaactgtctaaccaaaacaagtcttaaaccttattttgttttcttcctaacatttattcctccctttaattttttttttttaattcatggaaataggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacagaagcaaacagatgaggtgaatgtttcagatgtaccctcccaatcatctacagcatcaactggtcatgacacatttttagaaggcttaccatgtactcagctaggttgtaagactacagaagaccccataaaactacacagtgctcaaggagttaatgcagagtcgaaaagttaagacatgaatgtgtctaaccatatgcaattcagttcagtgaactgaacatccatgtatgacaggcactgtggggaaaccccaacatataaggatacaagattcatcatcttgtatctttaaaaacaactgcccacccacaaagtcaggaattggataatgtggagaatgaaagtcaagtcctaaaacaaaggttaaaaaatccctgtaaagacagaagcatgtatgtcactgtcttcaatcttctgaatggctacaggaagaagggcctagatctgtgtaaagtgaccctaggccagataaccaaaaataaacaaattttacctcaattttaaaaagtaactcttggattagagcactgtttcctggaaaataaagaagaatcttggatttctatttctggattaaatggaataacaaggactggatttatttgccctactgcccacaccattaagaaattaacacacacacacacacacacacacacacacacacacacacacacacacacacacgctgaagcaggcgggtcacgaggtcaggagatcgagaccatcctggctaacacggtgaagccccgtctctatttaaaatacaaaaaattagccaggcatggtggcacgcacctgtagtcccagctactcgggaggctgaggcaggagaatcgcttgaatctgggagatggaggttgcagtgagccaagacagcaccactgcatgccagcctgggcgacagagcgagactccgtctcaaacaaacaaacaaaaaaacataaaacaagcttgtcagcaactggaaattaggcaacaaagtacagagatcctgaaagatggaaaacaaattatgtgagccctaaaatttctctttgcctttagagagttttcaagccactgttcagggagaggaaatgcctgacagattccctgaattgcccagacagagttctgagaccagggaaaccaaagtgattacacttcgtaagatagagtaatggagaggagagagctgcatagaggaaaaattgaagcaatctgtggaggagttcctgtcaacattcatcagagtactgattgatgtatgtacatgagaaatctcccaaaacaaagggattagtgagaacaatgcctgaggctcatacaagggccagtaatagtgcctgtctctaccagccatactgtaaaacctcaaaacttatgggcaacttggtagagcacactgaagggtcctcccttagtagtagacaataattagccctagactaaacactgcttcagttccatctaacaaatcttaaaagcaagatctaaaggaatcaaattgtttctctgtgcaaaagagttcaaaatgtttttgaactcttttgaacaaaagagtttgaacaaaatattttgaacaaaagagtttgaacaaaagagtttgaacaaaatattttgaacaaaagagttcaaaaatatttttagtaatacaaaatatccagcttcaaacaaggcaagaatcgcaatgtctggcatctaatacgaaattacctggcatgcaaagaggcaggaaaatgcaacccataatgagaaggaaaaatatcaatcaatttaaactgacccagaactgatccagttgtcaggattagcaaacaagaacattaaaagttactgtaactatatcccatatgtaaaaaaaattaagaaatagaatatattaacaagactcacattggacttccaaaggtgaaaattacaatgtccaagacgaaaaataatgctggatgggatgaacaataaattgcacttcacagaaggcattgaagacatgcactagaaactatccaaaatggaatacagagataacaaataatttttgaaaatgaaaaaagcatcactgagatgagtaacaacttaaagtgactgaatatacatgttgttggaggaaaagaaaaatggcgggagattttttaaattgacaaaataatgtccaaaaattttccaaatttaatgaaaccataaatccacagatccaagaagctcaacaaaccccaaacacaagaaataaatggctaataaagagaaaagcttagaatcagtcagaaaaaaggatctctctctctctctctctctctctctctctctatatatatatacacacacacacatatatacatgaattatatatatgggtgtatatatatatatatatatatatatatatgaacaaagataggactgatggcagatttataatttgaagcaatgcaaacaagaagaccaaagtgtaacatatttaattactaggataaaaatctgtcaatttaaaatttcatgcacagcaataatatcttacaaaaacaaaatcagaaagcatgcatcactaactgacaaaatataagaaatagtaaaagacatcctttaggctgaaagaaaatgacactagatgaaaacatgaatgatactcaaagaaatgaagagtaccaaagttagtatctacatgggtaaatatataaaatcatttatgctattacttaaataccgaaaaaataattaagaaaaaacaataaagataaattgtggaatttttaacatatatgtgaataacacatatgacaaaaactgcataaggcttggaagagaggaagaacagtatactattataagattcctatgctatacttgaaatagtattatatcacttgaaggtaactgtgatatgttagatattcatgctgtaaaccctgaagcaaacactaaatttttttaaaaaagagttattgctaataaagtcaacaaaggagatataatggaatcataaaaactatccaaaagaagatagaaaaagaagagaaataaaagatgggataatatttaaaaaaagaaagatgataaccttaaacctaaacatacaaatatcacattattaagcaggtcatggactctaaaataaatagttaacaaagaaacaaacaaatatcacattaaatataaatggtctaaacaccccaactttacggtctaaacaccccaaagttaataatgccagcttggattaaaaaataagatccaactatatactatcttccagaaacacacttttaatacaaagcaatgatagtataaaagtaaagtgatggctgcggacggtggctcacacctataatcccagcactttgtgaggctgaggcgggtggatcaccagaggtccggagtttgagatcagcctggccaacatggcgaaaccccatctctactaaaaatacaaaaattagctggggtggtggcgggtgcctgtaatctcagctactcaggaggctaaggcaggagaatcgcttgaatccaggaggcagaggttgtgttggctgagactgtgccattgcgctccagcctagacgacaaaagcgaaattctgcctcaaaaaacaaaaaaaaagtaaagtaataggaaattatagactttaacactaatcaaaagaaagctggagtacttagacaaagtagatttcagaacagaatgtaacagaaatatgcaaggtcatttcacaatataaagggatccattcatcaagagaatatgaaaattctaaatgtttatgaacttaaataacaataacttcaaaatatataaaataaaacatgataaaactgcagaagaaataagtccataatcagaggttttaatacccctctctcaaatattgatacaagaagacagaaaatcagaaaggctccagaagacttgaataacataattaaccgattttatctaacaggcatttataaaatacccataaataagtggatacacattattttaaagtgaacactgaatacagcaatagaccatctagaccaaaaactagtctcaataaatttaaaatgtttaaagtcataaaaacatattttctgactatagcggaatcaaaaatcaacaacaaaaatttctgaaaaaactcccaaatatttgaaaacgaagtggcatgcctctaaataactcataagtcaaagaagaaaacaaaagtgaaattggaaatactttgaactgaatgaaaatgaaaacgcaacataacacaatctttgagatactactaaagcagtagttaagagggaatgactacattacaagaaaggtctcaaatcaatagcctcagctaccatttcaaaaattaaaatgcggagaaaaccaaactcaaagtaagccaaacaaagaaaattataataaaaattagaggataaatcaatgaaataggaaacaataagcaaaaacagataaaaccgaaagttgattctttgaaaatacaaataaatgtcatagctatctagccaaactgatctagaaaaaaaacagaggagacacacattaccaatatcaagatgagactaatatcactataatctcaacagatttcaaaagaatagtaacggaatgtcataaacaactttttccaataaatttgataatttacatggaatgaacaagttccttaaaacacacaagctgccaaagatcactcaagaagaaacagataatctaagtaaatctatatctattaaataactaaattagtagttaaaaaccttcttgcaagaaaaggtctaagcccagatgccttcactggtgaattctaaaaaatgattaagaaaaaaatactatcaattttaaccacagtgattctctgagaagacagatacacttcagaaaactgaaaaggagaaaatattttataattcattttgtgagaccagaatgatcctaattaaaacaaacagataaaacaacctacacattcctgggataaatctcacatagtaggttgttttataatatgaaaatctatcaatgtgacttatcatattaacaaatttagagagataaactatacaatcattttaatagacacagaaaattcaacatctgtttccaatggaaacaaaacagagcctttgcagcagactagaaatagaagataccttcttcgagctaactatcctaaatatatatgcacccaatataggagcacccagattcataaagcaagtccttagagacttacaaagagacttagactcccacacaataataatgggagactttaacaccccactgtcaacattagatagatcaatgagacagaaagttaacaaggatatccaggaattgaactcagctctgcaccaagcggacctaatagacatctacagaactatccaccccaatcaacagaatatacattcttctcagcaccacatcgcagttattccaaaattgatcacacagtgggaagtaaagcactcctcagcaaatgtaaaagaaagaaattataacaaactgtctctcagaacacagtgcaatcaaactagaactcaggattaagaaactcactcaaaaccgctcaactacatggaaactgaacaacttgctcctgaatgactactgggtacataacgaaatgaaagcggaaataaagatgttctttgaaaccaatgagaacaggacacaacataccagaatctctgggacacatttaaagcagtgtgtagagggagatttatagcactaaatgcccacaggagaaagcaagaaagatctgaaactgacaccctaacatcataattaaaagaactagagaagcaagagcaaacacacaaaagctagcagaaggcaagaaataactaagatgagagcagaactgaaggagatagagacaaaaaaaaaaaaacccttcaaaaaatcaatgaatccaggagctggttttttgaaaaaatcaacaaaattgatagactactagcaagactcataaagaataaaagagagaagaatcaaatagacgcaataaaaaatgataaaggggatatcaccaccgatcccacagaaatacaaactaccattagagaatactataaacacctctatgcaaataaactagaaaatctagaagaaatggataaattcctggacacatacagcctcctcccaagactaaaccaggaagaagttgaatccctgaatagaccaataacaggttctgaaattgaggccataattaatagcctactaaccaaaataagtccaggaccagatggattcacagccgaattctaccagaggtacaaagatgagctggtaccattccttctgaaactattcaaatcaatagaaaaagagggaatcctccctaattcattttatgaggccaacatcatcctgataccaaagcctggcagagacacaacaaaaaaagagaattttagaccaatatccctgatgaacatcgatgcaaaaatcttcaataaaatattggcaaaccaaatccagcagcacatcaaaaagcttatccaccacaatcaagttggcttcatccctgggatgcaaggctggttcaatatccgcaaatcaataaatgtaatccagcaataaactgaaacaaagacaaaaaacacatgattatctcaatagctgcagaaaaggccttggacaaaattcaacagtgcttcatgctcaaaactctcaataaactaggtactgatgggacgtatctcaaaataataagagctatttatgacaaacccacaaccaatatcatactgaatgggcaaaaactggaagcattctctttgaaaactggcacaagacagggatgccctctctcaccactcctattcaacatagtgttggaagttctggccagggcaatcagagaggagaaagaaataaagggtattcaattaggaaaagaggaagtcaaattgtccctgtttgcagatgacatgattgtatatttagaaaaccccatcgtctcagcacaaaatcttctcaagctgataagcaacttcagcaaagtctcaggatacaaaatcaatctgcaaaaatcacaagcattcctatacaccaataacagacagagagccaaatcatgagtgaactcccattcacaattgcttcaaagagaataaaatacctaggaatccaacttacaagggatgtgaaggacctcttcacgaagaactacaaaccactgctcaacaaaataaaagaggacacaaacaaatggaagaacattccatgctcatggataggaagaatcaatattgtgaaaattgccatgctgccaaagataatttatagattcagtgccatccccagcaagctaccaatgactttcttcacagaattggaaaaaactactttaaagttcatatggaaccaaaaaagagcccacattgccaagacaatcctaagtaaaaagaacaaagctggaggcatcacactacctgacttcaaactatactaaaaggctacagtaaccaaaacggcatggtactggtaccaaaacagagttatagaccaatggaacacaatagagcccccggaaacaataccacacatctataaccatctgatctttgacaaatctgacaaaaacaagaaatggggaaaggattccctatttaataaatggtgctgggaaaactggctagccatatgtagaaagctgaaactggatcccttccttacatcttatacaaaaattaattaaggatggattaaagacttaaatgttagacctaaaaccataaaaaccctagaagaaaacctaggcaataccattcaggccataggcatgggcaaggatttcatgactaaagcaccaaaagcaatggcaacacaagccaaaattgacaaatgggatctaattaaactaaagagcttctgcacaacaaaagaaactaccagcagagtgaacaggcaacctacagaatgggagaaaatttttgcaatctactcatgtgacaataggctaatatccagaatctacaaagaacttaaacaaatttagaagaaaaaaatcaaacaaacacatcaaaaagtgggcaaaggatatgaacagacacttctcaaaagaagacatttatgcagccaacagacacatgaaaaaatgctcatcatcactggccatcagagaaacacaaatcaaaaccacaatgagataccatctcacaccagttagaatggcaatcattaaaaagtcagaaaacaacaggtgctggagaggatgtggagaaataggaagacttttacactgttggtgggaacgtaaactagttgaaccattgtggaagacagtgtggcgattcctcaaggatctagaactagaaataccatttgacccagccatcccattactgggtatatacccaaaggattataaatcatgctgctataaagacacgtgcacacgtatgtttattgtggcactattcacaatagcaaagacttggaaccaacccaaatgtccaacaatgatagactggattaagaaaatgtggcacatatacaccatgaaatactatgcagccatgaaaaaggatgagttcatgtcctttgtagggacatggatgaagctggaaaccatcattctcagcaaactatcacaaggacagaaaaccaaacaccgcatgttctcactcataggtgggaattgaacaatgagaacacttggacatagggtggggaacatcacacaccagggcctgtcatggggtgggggcaggggggacggatagcattaggagatatacctaatgtaaatgatgagttaatgggtacagcacaccaacatggcacatgtatacatatgtaaaaaacctgcacgttgtacacatgtaccctagaacttaaagtataataaaaaaaataaaaaatgaagataccttcttcgatgtaatcaaacactacattaaaaaacaacaacaacatacaattagcatcatacttaatggtgaaagactaaatgcctgagattagaaaaacaggcaaagatgtctgctcttaccacttctgttcaatatagtactaaaattcctagctagaacaattagacaagtaatacataaataaataaacgtcatcaaaattggaaagaaagaaatataattgtctctgtatgcagatgacatgatcatgcatacagaaaactttaggaagaactgagctttctaacagtggaggcatgtaatcagtgcatgttgaagtgttaaagagaaagcaagactaggtgatctcctaagatccttccaatgctgaaatttttctgctgatatagaagaggtactccaaggcaaggaatggagtatgccaaataaacagtagagagaatgagtgagtgcactatgttgagagagagaagactttctgctgaaagggtcaagcaccctagtggaagaagcaacacttgagtttcaatgtaaactctacatagtctataagaacaagcactgtgctgggcataagacagacctggttacaaagcctggctctgtcatacgtgtttatgggacttcaggaaagtcacatacgtctttgggatttacttactttatctgtagaacaaagttcatgatcattcttaagttacattgttttttatttgtttgttttaattctgagaagaacggcaccctatggagatgtgatagagatgtgaagcgttattgttaaagtgtaaacccactgttggaggactttcatttcccttggttatctgtggtttacaaacctctgctattataaaacagcactccagaaggacaaagacacacacacacacacacacacacaaaatacacacccacccattcacagacagtggtaaatctcacccacataaaaataacgtacatacagataaatacaaacacacagacacttcagtttgcctatgcatattcagatacacagtcttgcgcaaacacatatgcactccatacagagtcaaaagtcagaattaacaaagtttgaaagatgaggcaaaatcagctgcccagttactgttccatgacctgtccctctgtgaaagtgatgtccactccagtctgttctgtctctttcagtcaataatgtggaaaaagccacattaatcccaggaaacctattagcagccaacttgacttctcatgttgtccataatctgggcttttctttttctgacttcttttacattcacagcctcattttatcactttcttcccaatttcagaggaagcaaagcaaaaatagcccagagaggaatgggagaggtgtaggagagagacaggtagaagacaggaagacagaaaaagaaaagggaacaataaaggtcctttcattcttttattattcattcagtcaactcatatttgaatgccagactttgtgataggtgttggaaatttaactatgactaacacagagaaggcatctttcctcttggagtttataatttaattgggcaaataattatacttctttaattctttaaatagccaagtcttggttcaggattaaaattataaatttgaggcgataccacaagctgaataaccttggattaatctcaatgttctaatctgtgaaatgggcacaataatcactaactctcctaaaattgtgaggattaagatgctgaacaaaacatttagctccgtgcctggcacacaaaaaaacagatgtctaattgatgttttctagctggaaaataattgctgaatggaagtctcaacagagaacagaaaatgtaagccccagtacagatcacaggtgaacgctttgcttcttggcagtgtcaaaatttagaagaactcggaaataatgttctgagtgataatcaaaggtatccctcttaaaagccaacattctcaaatgctcctgcatgctggaatcacttccaattatctctctcccagcactagttaatgaagactccaagtgtatctcactagaaagccaattgtgtgaatttccttacctcagttccagagataatatatttacagatcaagcccttcaagcatgagtcctgcaggccttcccagatacagaaaggtcaaattgtcttcagaatcaactagttctctgacataatattttgaaggtccaactcagagaatcagacactctttctaactgcaacttgctatctttccttgatcaaattcatacaaaacagcacacaaggatggacagcgaaaaatcactaaacaatgaaatcttccaatgccttcccaagacagatgagaccaagtctccaaagacagtagaaaatcccagtttccctcttctgtcatactatcccaagaaaatgggaactcatgtacctacctgtgtacaggtcagtgtctgtgtattcatccactttcttatgctgcagaatatagtcggagaccttggtcccaatagctggctgaacatccacccactccaaggagaccacagtactggagggctccactgttggggacagccgcagcctacagggaataaaaaggaagattcgtgtttggcagccagcaccagctggggcccaaaagaatccgcatgtgtcaagatgaagcataggtttcagtctgaatttaaatcttgattccacccatgatcgccaacttgcatgaccgtaggcaagttatttcccctctcatggcctctgtttctcatccataaaatagggagacaaggagccacctttcaagatcaaagtagaatttcataaattaatccatgcacacaatatgtgctcaatggcagtttatcagttttccatatatttatactatattctcaacgatgcttcactttcaattaaattggcagtgccttcaaacaaaggaactttccatttttctgccattttctttaatacaatgtactagctaactttttaatatccttaagtaaatacactattggaaggagcaaaaatcctggagtaaatctttttgcaaagcaagaaaaaaaaatagaatgattaaaggttagaactagaatggtccttagagatgatgaagtttaattccctcatttcacaaaagggggaaaggctcaaaaaaaggaaacagtttgcacaaggtcacacaacaagctgaagacaggaccatgatggtgattttgcttatccttatcccagattccctttttccacgataccacactgtgtcttcaaagaccatcttataacatgattcttctcacccacagagttcgattatgggactttgttttccagtattggttcctgccccctcttatgcttgtcacaccacttctccctcttaatcacatgcttgcaacgacaatgactttcctttacttcctcagatggtgaatttccagtgtctggcccttcgcatatgctgttccttctgcctgagacatgagtctcaccacttgttgcctggctggcatctaccctataggtctcttcagagagctttcccagactattccctcttccttccaactaaaacatctccccattattctccctaatagcacttctttgtttctttttcacatttttcttattaaaaaaatgttgttgttgagacagggtctcactctgtcaccagggctgtagtgcagtggtgaaagcatggatcactgcagccttgaattcctgggctcaagagatcctaccacctcagcctccatagtagctgggactacaggcatgtgccaccacacgggctattttttttttttttttttttttttggagagacgaggtctcattatgttgcccaagctggtctcaattcctggcctcaagagatcctcccacctcacctcctaaagtgcagggattacaggcatgagccatggtgctcagcccttatttaaacttttatactgtattttcctgtttttgttttggcatctatctcctccactaaattgtccgttccctgagtacatggactgtgccaatcttgtttcgtagaagaggttctccagtttttttttgttctgttttgttttaaatctcagtagccccattgcccaacacaagacctgacaaagtagtcagctgcctacaagcttttgctgaatggttgcctgaaggaagaaatgatgaactgagtggcatcatttaaaacaagcatgcactgcaatatcagtgtctgctcctgtgccacaattctgttctgccaaagctcccttctttcctaaaaaaggaggtagattccagggtctttgaggatcttgttaggcaccttgggagcagaagcaagtcatggcatgggctggcaggacaggagtgtgagtccacgaaaagggatggccaaaggaaaaggggccatacatacgtacaccggctgcagaagggggctgcagttggggagcccattggcatcaaaggcgctgaggtcacacctgcaccagtcatcgatcacatcccctttccctgagcaccagtaggaactcatcagtgcactcttgaaggcctggacaaaaaaagaggacagaatagacaatgatgacaacaggggagagattgagagtaaatgtgctgatggccatgatgtgagccatcgagggctttagagtagcccctttaagcacaagacaccatctattccctaagttccttgcactctactatcagggtctcccatcctgagccatcccctccccaggagccacaatgatcactgagaaacaatagtaactatatccattgatagtgtcccctaggcttggcactccacttgtgttaacttatttaatcttcacaacaacctcacacaatagatattattattataatttcccattttacaagttggaaaactgaagcacacagaaagtaaataacttgactgaggtttacgatagcgatagagctaggatacaacccaaggcaatctgcctccaaagcctgtcttcttattaaacaccttgctgcactgccttttatagaagtctgaccatctcattgcccagcttaaaaaccttcaaaggtttcccatagtcttcaggataaaatctaaatgccttgttctcacccctggccaccttttcatctctcaccactctcctgaccttctttgcacagtatcatctgttctcatgcacccacatcatttccaccaacagtgaattcctgtttatataaaatgtgctctaaatcaggagccagaaaacagtttctataacgggccagagagtaaatatttttggctttgggacaaggtagactcttccacaattacttaacactgcctttgtagcatgaaagtggcatagatgatactttacatgaattggcatggttgtgttcctataaaactttatttaccaagtcaagtagcaggctagattaggtctgagggccacagttttctgacctttgctctaaatgataatcaatgttctatttaattggaatgtgcttcatagtctttttaaaacacatacacacacacacacacacacatgcacgcacacacacacacacacacacacattccattctatgcctggaatattcccctctctgcactccaatttactctttgggtctcaaataggaaacattctcttctctggaaagcccaccctaactttcttaagtctagaatcatgctcctcttctggacaccataacacatagaccatacctaccaacacatttccttgcctatctcacccataaacactggtcccaccaagggcaagggccaggccttattcacatgaatattcctgtgggacctagcacagttattcagtcaacagtttgtaaataaataaatggacattgaaaaatagatcattaatagttggcagtaaagagaacttggaaggcacttttttcagtttagcacagcacaggagtcaagttttaccttctattttgttcccctcccttgggctctgatgtagaagataacttcagtgtgtgcttgatgctaacactgacatttcaacgcactgcacattctgaatgaatgacagctgtctttaaaacatgaggatttcaaagaatgttgatcttttattcctttgtgctttgcctgctctgcatgatgttcctatttttcatttctttcatgttttttacttttgatatgcttttaaataaaagttgcacaccactaagggcacatgattaccaagatgtcacttttttcattctgcattgtctaaaagactcaagtagaacatgtttgtataaagtctggggtctcccttctgagtgatccagaacacagatctagaaggagacagtgtctatcaagagtgttcctgtgtaagcttccatcacatttctcctggaagttgacaaaaagtctccaattattcctgccacatgttcttatccatatcttctcctagggatgaatgaatgaatgatcaaatttcacctgagttaagtgtcatgacccaaagaaataaaaaataattataataaaagctaatgttcatgaaaaacactaaatggcacagcacatggtactgtaagtgcattaaaatgtaatcatcacaatagtcctgagacacagatattacgatcctcatttatatataagaaaactaggaatcagagcagtcgagcaattttcccaagatcacacagcaagtaaatggtggaaacagaatcccaacccagatttctgtgactcccaagggcaggtcttttctgttcaacaattctgagccatgggattaatcccaagtagggttgccagattcagtaaattaaaacacaaggtgctcagttaaattcaaattccaggcaacatttttgtagtgtaagtatatttcataaactatttgcatataaagtgtctgggccagggtgtgtcacacagtaagagcactgttcctcctaggtgccagaacctatgctaagaacaaatgtctattctctagccagcaccagaaggaggcactctcatgaggacagaaaccagatgcgactgcatgaggtcatgctgactgttagaccttttctcactccctttgcaggttcccccttggtaaaattaatgtgcttaactactgatggcttaaaattctgtaacatctccagccaacactgaaggcttaattaacataacggtgaaacccagggccatgggtgaaagtgacacagatgggaaggttgcactggaccccagcaatgggaagagagagagcatactctgtgtgtgtgtgtgtgtgtgtgtgtgtgtgtgtgtgtgtgtgtgtgtgtgtgtgtgtttggtttttgtaataaataggaacttgagcttgtggaaaacaaaacaggaaatctctctggacttcataagtttcaccatccaggcagttcttgggaagaaatcctgcctgtaagaatccacatccactggctctttcccaaaaccccgaggaacagaatggggactggtgcaatggccaggcaaacactggttagaacacaaacacaccctgataaaaggccagcatcaaacagggagtcctcataaggctgcagaagccagcactgtgtcaatgcaggatcactctttccttacctcttctgtccttgcaacactccatccagagtccaattagatcccgggggaggaaaatcatagaatgttccagcttcacaggactctgtaaatcatgtaacctaatccgtttcacagatgcagatacagtgacccagagatgctagtttgctggaccaaggtgatagaacaacttcacgatgaaactactctatccctccgttaagtgctcaaaattacccattgaaatggatgctcaatacccacttacagaaaagcgtgcaggagcagggagggacttgaactaaagcccatttgaatccttgtacccttgaccttagtaggtcacacaggaagaataaatgccaagatttgatccaaaatatcctgttcagccactctgcttgggtcatgtgcttatgtgtgtgcatgtgttgtttgcatgcgtatgtgtctctgtgtgtttgagagaaaatgaaaccttatactggaggcattattgcctcctagtttttgaataagtagagggacctaagaaacaaattctgtacttaatggctacatttgcatggccattggttttcataacgaaggtttgcatttccatgacttgtaaacgcttccaacttctggctaattagctagcaaaccaagctgggcaacaggagaaaacagccacaaaaatattaagcaatcaaaaaaaactaggatgtatttctgactctcttgttactttcctttttgaacttgcataaaagattcctcgttcttaacctcaatttccctatctccaaatgagggggtagaagatatgttttctaaggtttaagttcagtacacattcactgaacttcctacttcataccttgtgccttccagaaactaagaaagggaatgaacaagaccaagtcactaacttcaaaggatccgtggcttattagcaaagagacacacacaaacaattacaattactatagttcaaatgctatgaagtaatacacatagaaggctatgagaatacagaaggaagggggctcttctagctctaaaactatgacaatatcttaggaattttaaactttaggtaaacaccctctacttaagatatttagaaacatctacacagaatgtcactaagcccatgaattaaattccacactctatacttcaaatgactgtaatttttacactaaaaaatattttcatgtgctaataccaagtcagttatttttgatactaagatggttctggtctgtatgactccaaaaagatgctctgaagtccttattaatgcctaatggatttcatctccacggtattaacaaacttggtcatatggctgctcaacccataacaaatgaagcgggaaaaggctttctagagaaaaaaaaaaaatctattatctttttacccactggctccattttagggccaaacacagtatctagcatttaacataaggcagtcaatgtttgttgaattaaaagttcacatggaatgctgaataaaacaaaccaaataaatgataaaagcaaagaaaatgtgtgtgcatgtttgtgatcctcttcttccccaggattacttgtatctcccatgtcagtttggtgcttctagccaaaaagtggtggtcaaccctctaccttataaggcatctcaaaaccaacctcccagctgggcacagtggctcacacctgtaatcccagcactttggaaggccgaggcgggtggatcacgaggtcaggagttcgagaccagcctggccaacatggtggaaccccatctctactctactaaaaatacaaaacttagtcaggtgtggtggtgggtgcctgtaatcacagttactcgggaggctgaggaaggagaatagcttgaacccgggaggtggaggttgcagtgagctgagattgcgctactgcactccagcctgggcgacagcaagactccatcttggaaaaaataaagaaaccctccccactctggccccattgctgtctccctggtgccgcccattctataggcacttgccgtggcctttggactagtctccccactctcatgttgccttctccagcatgtcctctcacagctttctaaaacacctcttgcttggagccttttgaatgttccacactttctggttaaagcctccactgattcaacctcctttgttcttcagcttatgactcttctcccatctcaacccccctgcacccctctctgtgatctagcacatgccaacttcttacagtagtgcatgcactatttcatacccacaagccttttctcatgctgtgcctttggtctgaagtgccctttttccacttcttcctccttactgaactctaggaaggaggtgtggaccctgccacaccttgagagattttgtccctctctcctctcattcaatttttacaaatttcacatttccttgaaacttgcttatttgtgtgtcctcgcctatcaaactgtgaacttctccatggcaaggtcataaatttgtgttttttgtttttttgagacagagtctccctttgttgcccaggctagagtgcggtggcacaatattggctcacggcaatctctgcctcctgggttcaagagattctcctgcctcagcctcctgagtagctgggattgcaggcatgtaccaccatgcctggttagtttttgtgtttttttttttttttttttttttttttttttggtagagacactgtttcatcatgttgactaggctggtctcgaaatcctgatctcaagtgatctgcctgcctcagcctctcaaagtgctgggattataggcataagccactgcacccagccaaggtcataaatttgattcatctctgtgtccctaccttcaagaaaaatagtgaacaaatagggccccaaaaatatgttttaaatatgttataaacatacttatatttaaatatgttttaaatataaaataggatgttctgccaaggattaaacttgtgtacttgatattattgtgttcttctaacaaaagagatgacagaaatgcatctcttttggtcaccataaaaagcctaaattaccttgaagccattgaaaggaaattggggtgggctatggaggtagagtcccttttggagacaattgtgatcacagcttggaggacagtggggttgataccttttttgtccagaagtttttgaagatataaaataagaagcttctaaggcctagaaagatgggaggtgaagagatagtggttgacatcccaactttatggggaaacatatattgtaagcatggtgcgcccatgctgacaatatgtgtagttgatcaggacggaattgatgaacacaggaaggattgaagaggttatcatagcagtgctgcaaaaaaaagcagaaatagaggtttctaacccagcctggaactctggataggatctacctgggccatctgccatccgtcatcagcatatctcctcataattgctgcagaagattccaattacccatttccctggtagccataggagatagggcacaggggctggaggccccattccttaggaatgaaacaagacatgcccatctaacctgacagtgagaaggtgattaattggtcattcttttacaaatcaaagaatgtagaattaagtagcatgtgtaaaaacacataaagggagaaaagtaggtagtgttagttgacttaaatcttcttattcccaaacaagacaggaaggcaagtgagatgagtcatgtcaaaaattgcctggaaaaggtagcaactagggagtagccgagcaatgggaagtagaaaccttaaactacatatatatcccagaagctagagggctctgaagtgcatacaagcatattcattggcacggattcttggcatttcagatccagaagggtcctgagacatgaagctggtcctcacaactctgcacagactaggaggcccaaagaagagaaacattcactacaccaagttgcctgcatttggtcctgggttcaagccaccaacttctgtcattttagtagaaaacaagcataacaacagcatttactgacagggtggtaagcactttaatatacattatatcatttaatcatgtcagccttatgtagtagttttgctgttcctagccccattttatagattaggaaactgaggtctgaagggtaaaatagcctgttcaaggtcactcgctaaaatgtagtagaaccaggacttgaactcaagccatctaatcctgaagcccatgctgtcagccactacaaccataagcaatgttctcactgaagtagagaatattaataattacgtgatatttattgagtacttactacaagccaggcactgttctaggttctttttatgtattactcctcacaataccctaggtactttagacatattaactcattaaattttcccaacaacctgtgagctaggtgtagttattatatccaatttgcatttgtttccaaggtcacagagctggtaagtggtagagccaggctttgaattcaggacatttggcttaaaccaggaaatctatgctttgaaatataaagcctccatataaaagacaatccatttattaaaaatgttattcacacccctgagtccacccacctttagcagatattgggatttttcactgtacaaatgagaatggaccaatgaaaatatcatatgaaattgcaattttgtaagtcaaatgtcagcaatatcatatagttcaatgtaatagaagccacaagtgtgaacaaaatcacacagaaaaagtacagagcatgaaaagagtaaagagacaaagataagagaatccaagggaactccaacattttctaatttactgtgtgacctcagtaagtctcttcccctccttgggtctttcttcaagttggacattcaaatcactgcattgctatttctgatcactttctcacttatgctaagatttagctgtttctcaaaactggccataatttccccatcccctttagaacttcccatcctagatatactgactagaattgactgccagcaggctaacctatggagacagtaaaaggatccgtggtttccagaggttagggagaagtgaaggatgaataagcagagcacaaaggacttacagggcagtgaaaatactctgtgtgataagatactggtgtatacatggaattatacatttgtaaaaacccacagaaaatacaacatcaaaagggaaccctcttataaactatgcactttgggtactaacgatgtgtcaatgcaggttcactgattgtggcaaatgtaccactctggtggagatgttaatagtgggggaggctatgtgtatatggggtagagggtatatgggaattctctgctcactttggctgagaacataaaactactctagagaaagtctatttgacttcctgccagctggcatcctctccgcagaggtcacacagatgacgagcataccattaacagtttttgaagaaagagaggagtgggatgaagagaacagacacctattaagcatttctttattctgtgcctagtgctagggcatctccctgttagttcctattatcctcccaacaatttgcggaggcagcagcttttactgtttccagtaactctttttttttttttttttttttttgagacggagtctcgctctgttgcccaggctggagtgcagtggcgcaatctcagctcactgcaaactccacctcccgggttcacgccattctcctgcctcagcctctggagtagctgggactccaggcgcctgccaccatgcccggctaattttttgcatttttggtagagatggggtttcactgtgttagccaggatggtcttgagcttctgacctcatgatccacctgccttggcctcccaaagtgctgggattacaggcgtgagccaccgcgcccggcctgtttccagtaattcttacagatgagcaagtgaaaggtcagagaagatactggatcaaggccaaccagacaacacagtagggcagagggtctattttggactcaacttcaaatcccaagcagtgccccctgaacttcttcaacccatctcttattttcagcctcagatccccccatacagtgaaaaaaatactaactggcaaggacccaattcctatataagaaatcgtgcagctcaatctattgctctataaatcacagaaacgacacctaatttcccctgtcaggataagcttcacttttcaagccattctcctctgaatgatgagagcccgacagaacagctccttaatctgggtgacaggaagaagacatttagaaccagccaaacccccctattgccacacttacctctgctaatgaaaaaatattagagaaataaatatacaacccactgagatgcttgtgcacaaggctctgtcagctgtctgtttctcaagatgtacacagacaagatgataggattatatgatcctcaggcaaggagtaatttttcttgtcagttagtcccatatttcagctcccatctatctcacatagaagatgaagtactatgttttaatgcattaaaaataacagtgagcattttttgaagacttttctattccaaacacagtgctcagtgagaaatgacatgcagggattcatttaatttgtagagcaacaccatgaatttgataatcctattggtgtcactatatagaggatgagactgaggccccagagagtttgggttcctttcctaagttacatagccagtatatagcagaacaaaactcagacccacgtttctcaaattccaaagcctaaatgcttaacctccatgggtcactttcatctccataaacagcctgtatattaggttgtattgtttccatgcaacccttgaaaaagttgaaattttttaaagtttgatgctcctgtgatcaggtgatttcatcaatgtcacaaatctaggaattaggactcaaacacaggtctcaacctaaagactgaatcctcttctccaaactggtcatttttcctaaatactaagggcaggtagcacatgacaaattcttaggaggagtgagggggaccagttaaccttgtcttggtcagtcccaagtccttctttgcgacaaccaaataatgacttaataaaaaaaaatagattcatgttggtctgggcaatacttttttgaatgagacctcaaaagcacaggcaataaaagcaaaaatagacaaataggattacatcaaattaaaaatcttcctttgttgactgcaaaggaaacagtcaatagagggaaaagacaaagtacagaatgagagaaaatacttgtaaattatggctctgacaaagggttaatatccagaatatataatagcaaaaaaatcccaaaacagaaaacatataatccaatttaaaaatgggcaagagagctgaatagacagtcctcaaaaaagatataaaagtggccaagtatatgaaaaaaatgcttaacatcactaattatcagggaaatgcaaatcaaaaccacaatgagatatcatctcactccaatttggacagttattacaaaaaagacaaaaaataacaaatgctgacataaatggtcagagaggggaactcttacacactgttggtgggaatataaattagtacagctatcatagaaaacagtatgagaattcctctaaaaattaaaaataaaactaccatataatccaataatctcactactgggcatatatacaaaggaaataaaatcagtatgctaaagagatatctgcactttcagcctgtgtcctgtttattgcagtactgttaacaataaccaagatatggactcaacctaagtgtccataaataaatgcatggataaagaaaatgtgatgtatatatacaatggagcattattcaaccatcaaaagaataaaattctgtcatttacagccacaggaatagaactggaggtaattatgttatatgaaataagccagctacagaaagaaaaatactacttgttctcattcatatgtggaagctgaaaaagtggatctcatggaggtggagagatgattggtagttaccagagcctaggaagggtaagagagagagagggggatgaaaacaggctggttaacagatacaaaaatacagttagttagaatgaataagatctggtgttcaatagtacagtaggatgactatagttaacaataatgtattgtattcaaaatagctggaagagaagaattagaatgttcccaatgtaaaaaaggaaaaaagataaatgttttggatgatggatatccgagttaccctgatttgataattatacattgcatgcatgtatcaaaatatcacatgtaggccgggcgtggtggctcacgcttgtaatcccaacactttgggatgccgaggcaggcggatcacaaggtcaagagatggagaccatcctggccaacatagtgaaaccccgtctctactaaaaacacaaaaattagctgggcgttgtggcacacacctgtagtgccagctactcgggaggctgaggcaggagagtcgcttgaacccaggaggtggaggttgcagtgagctgagattgtgccactgccctccacactggtgatagagtgagactgtgtcaaaagaaaaagaaaaagaagagagagagagagagagagagagagagacagagagagagagagagagagagagagggagagagagagaaagaaagaaaagaaagaaagaaagaaagaaagaaagaaagaaagaaagaaagaaggaaagaaagaaagaaagaaagaaagaaagaaagatcacaagtacccccaaaatatgtacaactattatgtatcaataataataaaaaaaaaagacctgtaatctcagcactttaagaggattgcttgaggccaggaatttgagaccagcctggccaatatagtgagacctcatctctattctgtatttctaaaaagaaaaacaataaaacaactaaaaataattttgactaagaaaaatacaaccatttttcttagcctggcacacacagcctttcacaaagtgatgtcaaacaacctctcagcctcatatcccaccgccatagcctgtcccagtcctacataccagctacattgaaccctttgtcatggaccagggaggcaacaaacttttatgtcactgtatctttgtacatgggttcccccagcctataatgcctttattctatctttaatcaaattgtactcattctttaagacccactgcaacttcagtcttctttgaaaacccttccttgatttcccagcagaattcaaaagcccttactgcacctttgacaacatatctgttagtggacttaccacattttatggaattgttatctatatgtctgtcctccctactggactatgagttatttgccttattttatcagaaattccttgcacaaggcatgacccaaagtaggtactccataaaagtttgttgtatgaacgcctgttgtatgaatgaataataaagtctgaggaaagaagactgggagctgtttgggtgtgtgatctatgtgatcttagtagacctgctcagtcatcggggcaatagattgtgcttacattgttctaaactatctccaaatcatttgtcctgcctgtcactaagctgagagcaattgtgaaagtgatgaatagcagaccaattatgagcaataggaaacatcggttataactctagggagaagacatagccatatcagtagcctcatccatctaatcatgagtcatcttcccaaggcatcttgctctgtgaccttgaattgtcaagggtttgttaatcttacacaaatttaagttcttcagaggatggttccccttttcagcctgtgtcctacaaggcgttgctcctggactgcccagtcctggaaggggaaacctggctggaactcacatacttttcctaagggaaacctttagctgaggattccagtcccacccaagagacaagacctgtcttctaagcctgctgtcctttgatagatagaaactcgtctttcctgtggtgagaacatctggagatgagaggcgggttggaaagtttcaagtgaaggatttgtccaagactgtggagtttgcatctctaaatgctagcttaagttaatggcaagttcctaaataaagaattacacaatttctcttctgtggccactgatgatttcatttttccagtacgcccattgtccctaaggaggtatctgagggaggaagcctctcctgctggtggggcttctatgggactatgagtgggggcaggaaaataaaggtcacaggacaggaggggacatgcttagtctagctagactcattctgagtttaccttggcctttgatagggagccttttaaatttggctgaggaagcttggaagtggtagattcttatcagctttaaggtagtcatatttctatcatggcaagtggattctgaaaagtctagatcatttaacccaggaaaggatgttacacgtgacggagggatggtagaacattgaggttaggagcatggtcactggaaccagactcctgggttcaaattccagtgctatcactaagcaaactgacagaatcatcttcaactctctatgcttcactttctgcctgtataaaatgggtatatactaagatctacctcaattagaaatgtacaaggatcatgtataaagtgcctaaaataatgtcagatctatataaatatccacatatacttgataattaaacaaatattgactaggtcctgaacttgggtattctctagatgaaagaaagtaacttaataagcaaaatagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggaaggctgaggcaggagaatggcgtgaacccgggaggcggagcttgcagtgagccgagatcgcgccactgcaccccagcctgggcgacagagcgagactccgtctcaaaaaaaaaaaaaaaaaaaaaaaaaaataagcaaaataattttttaacagctgttagacatgcttatttacagacaaaagaaactcaaggcacatctacactcacttggaattatttttattctttgtaatattttctattgagaaaacaatatggcactggaacaagctatcagagatactatctttgcctttggggaagtaggactttccttgtttctgtgaactgattgcccttttaatttttgaatcagtggatctctaagggtaagacaattactattttttttatgcctactctgtgctggatgctttaataagaagcaagagaagaggattgggggagaaaaagagagagaagtgggggaagactaagaagaaaaaaaaggaagcaagaggaagctacaactaatattgatcaagtgttcaatcgtactagctattgctaaatgctttacatgcatagtcttatttaacagttaaatactattattacctccactgaggttataagtaattaaattatatctccatagtatgtggcaaaatgagagcttaaacctaagtctatctgattcaagtactgccttttctttacatccatcatcttatataacattcagagccaccctataaagtgggtgctcatattactcccatcttacatctaagaaaacggagctcaggtaggctaagttgaatgtacaatgtcatccaacaggtaagcatgaaatgtgaaatttaaatgtaaatctggttgacggttaaaaccatggttctctctatgacatctcactaaaacctctaaaatatcaaaatctcactggtaagtctgttcaccttgaatgtaattaatgctctcctgatacataaaaaataagcaaataaatctatctatatttatacctatatctataaacctatatattatctatacctatatattctccagctctattcaaaatgagtacctgcacatatgagaaaaaatcaccagggaagcactgtagagggatgagaagagcttcactaacatgtactaccctacctcaagcacctgctacgttatacttcaattgcctggtgttccctctgatttttggaagacaagcaataatttctgaaaaagctccaggttggagcaagctgaagttgaagaagccaagcccaaaagcccaagctcttttgatagtggatgtaggatctctgaaaaggcattaagaaaagggctttgaattgagctaatagatggttttcattgagttttgagacaaaaactttgattagatggtggagcaaaacccagtttccaaggggctgagaaataagaagtgagaacggagcaagaagttttatggtcaaagaaagatgaagtggaaaatgatagaagaaactctagaatccaagaaaggctatctgatgatagaacaggcttgcccatgccaaactgtagtggaaaaagccagtaatgacaaaggctctattctttgcatgctgagaccacaagctatggaaccagacaaacaagggtttaaatcttagctccataacctactgctatgtaatactgatacttctccttctgagcgtcagtctcctttagccactcaaaagttatgttttgaatacctactatgtatatggcactaaatatagaagctattgtgacccaggataagtctaaaagtctggaagcaagatacttgatttctatccttaactctaaggcaacggaaatagcctctgtgctttctaacttctttcttcataaatcacataccatacattaagatgtacttagacttgctgggtgcagtggctcatgcctgtaatcccagcactttgagaggctgatgcaggtggatcacctgaggtcaggagtcctagactagcctggccaacatggtgaaaccccatctctattaaaaatacaaatattagccagatgtggtggtgggtacctgtaatcccagctcccagctacttgggaggctgaggcaggaaaatcgtttgaacccgggaggtggaggttgcagtgagctgagattgcacactccagcctgggcgacagagtgagacttcatctcaaagaaaaaaaaaagaaagaaagaaaaagatgtacttagacatactgcagttatttcagagccctataatcagtatggcctggataagactgagttggctgtggattacatcatgatctctccccgaaaattcatgttgaatcttaatcctcaatgcaacagtattaagaggagtggtctttgggaggttattaagtcatgagggctctacctttataaatgggagtattatctttataaaagggctcaaggttaaagcaagtgctcttttgccctgccctttggtcctttctgccatgttaaggacacagtgttcctctcctcccaagtatgcagcaccaaggtgccatcttggaagcagagagcaaccctcaccaaacaccaatcctgccagcaccttcatcttggacttcccagcctccagaaccatgaggaaataaaattccgtataaattacccagtatcaagtattttgttagcagaaatggactaaggtagagtctacatcaagattcagacccatgtgatgacaaactgttgagggaactgggaatgatttccaggagagaagaaaaaatcaactgagacctaaaatatcttcaaatacttgaaagactgtcacttagaattggagagaggattaactttcactgagctttttctagtgcaaggcagtgttgctaagcaccttacatgaactatctcttaatttgtgaaacaattgtataaggtagatattattaatctcattttaccgatggtaaaacaaaagcttacgaatttaagtaacatcccaaaaggcatacagtatttttttgagacaaaagtagtatttaaaccctcatctctcgctttcaaaacatatgctctgtctagtaaatcaatagctaaaacctgctcagtacagtgttgataaacagaattagaaactacaaggacaagaaatgtatagaaaaatactttgattcaatataaagaaggggctgggtacggtagtacatgcctgtaatcccagtacttttggaggacaaggctagcagattacttgtgcccagctgttcaagacaagcctggaaaacatggcaaaactcccatttctacaaaaaatacaaaaattatccaagcatggtggcatgtgcctatagtcccagctacttgagaggctgaggttggaggatcgcttgagccagggagatcgaggctacagtgagcaatgatcgtgccactgcactccagcctgggtgacagagtgagacctggtctcaaaaaaatacatacatacataaagaaggatgttctagtagtggtggaacaggatgcttagtaggtcactcagcaaaccattccaggagaattcaaaaagaagctcttgcaggatataggagaaaagaatcaagtaatacatacaggttggcctagatgcctgtataaacccttctatttctttcttctcgtagcctctgttgtgatcaaaaaataaaacaatgaaatgtagagaaggaggaataagaggaaaagcagaaagtagcaaaaatatgataagtaagaatttgtctttactcagcacttattacgcaccagcacaaaactaaacatgttaatacccatctcatgcaatacagtattctcagatattaggaattattagtaaactctagttagtaaacataggtgagggaattaaggctcaaagtccattgccacaagtaactaacataggagagaggcaacaactagggcttgatgaaagatgtgaccagatgaaagacaatctttcaactactagagtaaaaagctcaagtttttctaatagatcacctttgtctacaggtttttcaatatgggctgtggggaattgccaaaaaaaaaaccatcaagcccgatcaagcctctagacctaactacacagttacaagaaatacaaggccagataaggacattaaataacaccatgtgaatgcaatcagcaaaatccaggttgtggggaactctgcagcacaaacaacccagttttatccataaaatatcccaaggaataaaaagagagatagacaggttagaagagactcacttatcagccaactacaacatttggatcttatttagtttctgatttgaaaaaacaaacaagtaccaaagatataagacaatccagtaaacatgaacaataatgggatgtttgatgatatagagaaattatcgttcatttaggaatcctggatagggcattaaggttatcttttgagtgtttatgtttaagagataaggattttaacatttacacatgaaattatctcatgtttgagatgtgtttcaaaattaccagggcagtgtagaagcagatgtgagaggaggtaacacaggattaatcactactaaaactagaagatgataggtacatggcagttcattattatattctctctacctttgtgtatgttatgcttttctgaactaagttgattttggagtgggtagcagatcctgggatttaacagtgctctcccaaatgggataatttggagatgaagctaaaaatgaaaaagaaacacatgatccaaggagaatccacattctttgtggtcttcctctcctctcaggatatgaatttatagcctggaatccttttgctcagagatgctaggcatgatgtaactctgtcacctagagaaggcactgcacagactgaccatctgtgtaatggtacaaactcatgctgctttcaactgcatatgcctggtgaattgtgagacacatctggaatgactttttttttcttcttagattaggaagaaatagaaagagagttggattgtttgtgaattctctccaggcccttaccaccactgttgactgaagttgcctaatgacctaagaagagctccctgtgaacagggttaagctccaaaagggatggagcctgcagcttgctcttcctggaagcccagcattgccctggctggggcagtctttgatgacaccctcagataaatgatggtggtgtgataaataagtagacattggacagctggaaaaaggattccagccctggctctgatatttgctagtcttacagggcttcagatgatggctggctacactctctgagtctcaagtttccttatctaaaaaatgaagataaacagtgctaccttcatgcttctattgaaaggagccaatgtatgtgaaaacaccatgaaagagtgtcagtgcaagctggtgacctttttttcactcattcattcaatcatttattttctttttaagtgtatttattgaatttctactatgcatcaggcactttactatcagctgtcggtataaggctgactaaaagttggtgtagtacctggtttcatgaagtttacctgctaatgtataggaaaatattttgacttaatataagaaaggatgttctctcggtgagggaaaccaaatgcttaggtgtcactgagcaagccatttgaaaactgggaatgttcagacacagtctccacaactttttgcaaggtgcaaaagaaaggaattgagaaatagactagggttgggttggatgcttctataatcccttccatttctgagtttatctgctgtttcttcctcataaactctgttatgaccataaaataaaataataaaatttggaagaggaggagacacaggcatcaatcagtttcaaaaaataaaagtataattagaaagtgtgataactgttatggaagaaagacaaagagacccaagaaagtaagtgaaaaaataaacaaggaggatcttatcaaatctggaaaccttggcaatctgataaatcagtaacagttcactcagtggaaagaaggggaaaaatacattccaactacagggaatagcctgtgcaaagtctctttggcaggacagagcacagtgtttccaaaaactagaagaagatcactatggctggagcacaggaagcaagagaagtaagaagacaagatgagttttaagaaattagaaggtttccgcccaagcagcccctgagcaccatggcaaggactttggtttttatcttaagagcaactggaagtcgataaatggttttaatcacgaaagtgatgtgagcaagttttagttttgaaaatatcactctggctgcaaagaagtggaaggattaaaagaggcaggggttgttattagacaggagactattgaaatagtacaggcaagatttggatcagtttgggaaagagtgaatgtattagagaaattcttaaggagataaatctacaggacttggaatgggttgtattttgtggggaatgggtgcaggtggaaaggaaagaggagttatcaaggctgactccttggtttcaggattttaaaaatggaaatagaaaatactgtcagaagaaagggaggcaattcatggcaaccatagtacagtggtctgcaagggttacaaatgagaagttactgtacttttattttatggtaggagccaatcctagaatgaatcgaagtgaatcaatgtagacagagatgcctgctttttcaaaagttttggctgttaagaaatgaagagacagtagctggagaaggtaactgaatgcaatgacattgtctttagcatgcattagactttaacttttatttaaaatttgaagaagagaagctagtagagaggaaagtgagaagaggctcaggtgctcaggtcaaatcctggctctacaagttcctatttgtaagaccttgagacaagtgatttagcttctccatgcctcagttttcatgttggggaaaaaaggataataatagcacccaccatgtggacttgatgagagggttcagtgagccaagtacataaagtgctttagctaagctcctggcaccatggaagtgctcagtaaatgtttgttattattaaaaggacaagggaaagcttttctgccattctctttttttattgcatgtaataactaattcaatgtcccatggaaaaaaaatattctctgacatgcaaaaatgtttgcatttgctaaaactgtatatctcgcatttcttattgaatctggtagtcttcaggtcccatgaaagagctatgttttccagttttgcaggtagacaagccaagtattaagttcctcttttgtaattgaccatgagtgtgttgagtaatatgtggattacttctccctcttttctttgatcttccctgttgccaaggattgcctgacagtctgattcttggccggttcacctccttctcagaatgcactaagatagaaaggaagtgacccacaatagcagagaaggtttaagctagattataggaagtacttgactttcttaatccctaaacaaggaattccctgaaggaatttcaaactgaaaatgacatatgaaccagtttgggtagtggttctcaagctcattttgtaccagaattacctggggaggctgggaaaatgaaggctcccaacccacaaaaaaaaaaaaacaaaaaaaaacagaatcagtaggaagagacaaggaaactccattttaaacaaacacttcccccattctcaccttaagtgattttgatccactgagacactctgagatccagaactccactcactaggcactcttgacctcccttattctgctgtactttttttgtatactttttaatatactatattatttactgtgctgattgcttatttcatgtctctctcacacacactccagtagaaattaatttcctagactgtgaagctataatgcctgctttgctcctcagggtatcccaagtgcccagaacagtgtctggccaataggagccccttagtcaatacttgttcaaatgatgtaaatggaattctcactcttcagccatctcatacatataccccccatctaactgacactgaccctcttagtttagtattctacaacatttgagtcaagaatatggatctattctccaggagaaaaatataagtaatgtataattctgcaaaaactttctagggatgagcatccaaagatcctataaagtcaaggatccccaaatgccaaattaacaacccttgccataaaatcagtcctggtccccgcaattcatcttctgttgctatagttgctactctaagactcaaatctagttatatttttccttgacctacaatcttgaaagactctatatggtttgcacagcacccgaattttacaacatggcattcaaagttgcccacaatgcagccttctgcctatcccttttccagttttatttctaccaaatctttcaggcctgttgcaagaatggctgactgaacacaaaagctttggactcagacattctgggtttgaattctcaccccacaattcactagccatgttatcttaagtaaattattcacctctctgaagtctcaggtttttgttttttaatttgtaaagtaagcataatagtgaatacttcaaatgtgttgtagggggacagagtaagagaacatatataaatacacatgaagcacttttttaaatgccaggcacatagttggcactcgataattgttaggttttattcttctattcttctattctacatgctcagcacatagtattgacacatttttctgtctcctgcttttccaatattgcttagtctagaccggggtttggcaaacctttcctgtaaaggactagaaagtaaacactttgagctttgcaccccatactgttttctgtagctactacttaattctgctgttgcagcaggaaagcagttatagatgatacgtaaatcaagatatgtggctatgtttcatagacttgatttataaaaataggaagcaggctggatgtggcccatgggccatagttttccaactttggtctagactagctttgaaatcttacagacctgggttcaagcttctctggggttccatctccttatctgttagataaggataataatagtacttccctcataagttgttggatgattaaattagataaagcatgtaaagtccttagcacagtttttggcacatagtacatatatatgtatctgatggatattattgtcttcatcatcaaaaaacttgctttgcagttctactatgtgcccatatccaccttcccttctttaagaattgtttccagattctccctctcagagtttctttctctcttctaacactattggaatgtctattgcactattcaaaaataaatcatgcatttgtgtagcatatgtaagtaattatagtagcatatgtgtccttgttactagactgtgtgctccttgaaggcacagtctgtgtcttgttcctctctatagcacattttctaacacagtatctggcacacagtaggcaaccaatgcaagataatcacagtgatggggctatagcgagggtgatgctggtagtgatagtagtggtgtagcatagtggtggcggtagtggtcatggttgtagtgatggtaggtactggtaataactgggggagggggtgagacttggctgttaatttctcttcaaagagtagttatttggaattctcttctcagttggagccaaaaagtggaaatgaaacaaacaagcttttctggcagagagaaagaatctgctggaaggtcagacaaccacaagactagaattacacatgactcttcctagagcagcatgaacagaaaatgctcacaggattggaagtctgaaaacccgagggctggaaagaaccattcagatctacagagtattttacagccttcaaaacattgaaagtctcttaatttttctacagacagctgtggggaaagttaccaccacccatttcccagatgagaaaactgagccttggaaaaataaaagatatttccaagggttgaaggcatgtcttacttcaaattcagccttggctatgtgacctgaaaaaactcagtcctcagctctgttcttagttttactatctgtaaaataaagaggttgatttgtaaaataaacaggataagattttaatagccctatctgctcataaatgctatgtcattgtgtgccactggtatggagtgcaagatatgtatatctttctcctcccagtattaaatttaaggagtaaaattggcattgtctctgaatgggaaacaaatttcaggtcacaggatgcctcttccaacctcaaaagatttgctttatattctgggtagaagttagagctgaccttatcacagtgccaaaggggaccttggatgaagttagcctgcttttctcatcatacagataaagaaatggagacctagacagtagaagcatgtccaatgtcatataataatcaaggacagagcctagttcagattcctagtgtctccgttttctagttttcccaaagaaaactcccaaccctgagatgaaaagggataaatactagattgcctactttacaaataagtaaaagtcagatcacatagacagtaaatggcagagaagggattcaaatccaactctgtctggctctttagtatgccactcctctgcctcctccacttggaagactctctttcacccaggagctaagttaacaaccacacaaagtcttgtacatttaagcaccagttgtgctgagccaagctctgtggctttgggctgtgtaagagccatttaacaggtggagggaggagatttatgcattaatcaaattattcttcataaagagtttttccctgcttctcttgttcaaaacaacagcacaaggtataatcaagggctcgtttccagcttaggcagaaggcatcatcttttcccatgcattcactggaatgtacctaaggagaccccaactacccaaggagctagggtccaatggtccccaaggccatcgagaataccttggtccagaatcagaggacaaaaataccccacaaacctcaggcatgtcatatcctctctctgttagtccctaactgtgccataaaatggggttcaggattttactcagagcctctactccaggggtagggagttctcatacagaggaacttccactctgcattagaatgagctatgatattcattgccaacagaatacaagttccagcaatgtttataaagtgagaaaatgcccctgagatccctccatttgtaaagtgcccttttgggttagccaatggcctctcccatacaaaatatgaatcctattctaaaatgtcatgtccctagcactttaggtaccagcaaagttttcaagtactatctagaagaggagttaccaaaggaaacatagaaaaagaaaagagccattttaaataaacatattcttatcactatcatagataacattcgtctgttaagtgatttcttcttggacattatgcattcattatctcttttgattcccatgaagtagggattgtgagaccacattttacaagtgtggaaactgaggtatgaagacaccattcagcatcacatagtgaatggggattgaggaaacatccaaacccaagccggtagagcaaagaacctgtactatctgcttccatgtaaataaagtgtcttgtaggaaactcagaaagaaactgactccacttatctgttttttaatttttgttttgttctgttttgttctttgttttttgaagtaggaaaagaaagtcccagaaagagaaaagaacttgctatgacctgctatgtctcagtgtgaaagcccaggcccctcaactataggtcagggctctgaagtgttttcttgtatccatgtggcctgtagagatgatagaaagatggaaaagtcatgggaggaagggtgatgggagttagtggcagagttggagaaaaaatgataaacaaaacgagagtagctgctttttcttcccaccagcgttgttttgtggccatattcccttcctccaggatcatttccagacctgcagtgggtctatcccactcattcccactgcaacctggctcctttggaaatgtctaaggcactccatcccttaggctgtcatgacactttaaacaggcctttcatttgtgtttggggagggaaagaagaaactggagacttggaggaagccgcctacagtctttcagctctaacatttctttgcaaggatcactaagaggaaaagagagtagaagtgagaagatagtgcccatgcctgtctgtttgctctaacttctcctggcttccccattgccctggggctaaactcctcaccacatgttgtacagttctgcctgacttctcttcagcattgtccatggagttttctcccagtctcagctccagccacactggttttcattctcttcctgaaatgggtcacatttgctcattcttcaggtgtttgcagaagttgggcattctaccagcaatgttctcattctcctcttcctttctgaaacctcagtcttccatattcattttatgcacttggcccccaaaagctcactttacatgtcactttctcaggaaagccttctctgactgcgtaaggccccttaatacacgcttgcaatccaccagcctagtactctatacagtcttgactctacttattagtgtgattgtttcattaatatctgtcttctccataagtctgtgaactccgtaaagataaagaccatatccacttgtcatactgttcactcttcagggtataacgcagtcttagcatacagtgggggctcaaagatacttaatgaatgaatgactagcacttccagctctacaggtctcctgcaaggagaacagtgacatctagtgaccactttcacactcttgggattctctgatcacacaccactaattagcctcagaaagacctcactggatttccaataagttgaatatttcaatgatgctgagggaacctggcatggaatccagacataggggaatctggctcctgcacaaacaggaaaggcaccaccagcctatctattgctatgcatgtgccaagaacacattgcaaaagtcccgtggcttggcttgtagtgtgccacattgcagatgaggacagtgtggcccagaaaggccgtcactggagcgagttcacagagcagtaaacagggatattcacaggctcattcaccaagtcccagaaggccagttaaacaaaactacatcctcactgatacaacactagtcgaaccactaggtatttttatttatttatgttttggagacagtgtctcattctgttacccaggttgaagtgcagtgacacaatcacagctcactgaagccttgacctcctccttgagcgcttgatgcgctcaagcgatcctcccacctcagcctccagagtagctggatgacaggtgtgcaccaccacaccaggccaattttttcttttcttttttttttttttgagacagagtcttgctctgttgcccagactggagtgcaatggtgcgatcttggctcactggaaccactgcctctcgggttcaagcgattctcctgcctcagcctcctgagtagctgggattataggtgcatgccaccacacccaactaagttttgtatttttagtagagatggggtttcaccatgttgtacaagctggtcttgaactcctgacctcatgatcagcccgtctcggcctcccaaagtgctaagattacaggtgtgagtcaccgcacttggcctaatttttctttcagaaatggtggtctccctatattgcccaggctggtcttgaacccactgggctcaagctatcctctcacctcaggctcccaaagtgctgggattacaggcgtgaaccactggccctgggcctgttcttgttatttattggaatctgcaatagcctcctcatggatctccttgattctactcttacattctcacagtctatcctgaccctgcagctggaggtgtggagacatacacatatgtattttattgttggtgttagtttggggacctctgatgcacagagttagattatttgcagtgttcagtttaggactgaagctcattgttgagccatgcatgggtaggctttatttatttgttcagttagctagttagttttaataaactttttaaactttaatgaactctcactaatctaccaccaaaaacaccagctaggagctgggcgcagtggcttacacctgtaattccagcactttgggaggctgaggcgagcagattgcttcaggtcagaagttcgagaccagcctggccaacatgttgaaaccttgtctctactaaaaatacaaaaattagccaggcatggtggtggacgcctgtaatcccagctactcaggaggctgaggcagaagaattgtttgaacccaggaggcggaggttgcagtgagccaagattgcgccactgcaccctagcctgggagacagagtgagactcagtctcaaacaaacaaacaaaaaaacaccagctaggaacttgagtacttacatgtaacatatgcttccttatgccattaccttagttttcctgactcaagatcaccatcatcctgtctcctatgttcatcacttccttgcttccctttttaaatcatatttattgcatctgtatttattcctaaaagatagtatatttgaggtgtaggtatgctttaacttaaagaagggaggaaagggtgttgtgccatataaaatctttggagccaggcatggtggctcttgcctgtaatcccagcactttgggaggccgaggtgggtggatcacctgaggccaggagttcaagaccagcctgaccaacatggtgaaaccccatctctactaaaaacacaaaaaattagctgggcatggtggcaggtacctgtaatcccagctactccggaggctgaggcaggagaatcgcttgaacccaggaggtggaggttgcagtgagctgagatcgcgccattgcactccagcctgggcaacaagaacaaaactgtctcaaaaaaaaaaaaaaaaatctttaggacttactttcttcagttaataatacattcattcatttcatattgacaggtatcactacagctcattcattttggttactgtagtatattctattgaatatatatcctgtgctttatttcaatgctgtcccatggatgggaatttgggttttttacagaggcctccttctgccacacaatctaatcccatcagcctcctgccaataaccatgcatcatcatcacctcatggcccacaggatagggtcaaaattccacaatttggcttacaatattgtggaaatgatcaggattcattttgtttctccctccgtccttggtcttagtcatgaggcatttcttttggtctttgtacaaacaatgttcttttcttccttaggtcatctacctgacactttccctacctcctttctcccatgccttctctttcctctatgaagctctgtatgagcactcaacaccctccagcacttagccaagaagtatgctgtgggaggggcacgggattcatagagttctactagacttagtcagtggtctaccagtggaggcccagggctgtctgggaggtgttgtagaaggaggagtggggatcaaatgggagatgctttatctcccttcctctgcctcattgaaatagtggcatcactattcctgattttatggattgaggttcaagaaagattgcatttggaaaaagtgttccataaagataagtttgcaaaccagtgaatcaataattcatatggtcccctcaagccctgccattctataattaaaagtgagagaaccgaagagaaaaaaagaagcaataatttcatggctaagcatataaactctggagcagaccaactttgagtaaatcacttaatatctttgaggtttcctcagctgtaaaaggggtacgatattaaaatgaaccatatgaaattgccattttataagtaaaaaatggccaaatgtcagcaatttcatatgaatcgaaccaatatatgtaagtaaatcacagatctggagggcagagtaaatgagataatgcaagtattgtactgaggtagatactgctaggttttcaccaaacccatgtcttctcctaggcacacagctaaaatccatttccctgtcttcatttcagacaggtatggacaatggctgagttctaatcaatagaatgcatgagaggtaaaaatgacatttgccactttcaggcttggtctatttaaacctatgatgtgcaaccctccctgttctttccccttccacagcaattgtggaagcatcaggtcaatgcagcacaaggaacaggctgagtccctgcactacttttttttttttttttaaaccaagtctcactctgttacccaggctggagtacaatggcacgatctcggctcactgcaacctccacctcccaggttcaagcaattctcctgcctcagcctcccaacgtagctgcgattacagatgcctgccaccacacctggcgaatctttgtgtttttagtagagatggggtttcaccatgttggccaggctgctctcaaactcctgacctcaggtaatccacccgccttggcctcccaaagtgttgagattacaggcatgagccaccatgcccagcctgcactacttctcataaagccccccatcaatcaaaaacatctatttgggatgttgcacaaacaaacaaacaaacaaaaaccttgattgtattaagccactgagatttaagggtttattgtttataacagctagtattgtcaaactatgtaagtatttagaacatggtaaggaatcaataaatgctagtaatcaccatgatgatgatatgatgatgatcatgatgacaatacccctggacaaagggtccacaagggtaggaggtaggagggctggtcaagtttgactgagtggctgggccaggggagctcacctcctttgtgccattgtcttggatgagggtataaagtggcaccacacggttgatttccagcagcactggtgtggggctcagctgctccttgcctggccggcggcaaaggtgacaggtagatggacagcgccccttctcctcacagcgaatctccacacctgaaatgagctggtcatctgacagcatctgggctgtcagcaaacctgagaggtaggtgatgaagggcatggacttgagctccttcttgctgcccagctctgtggtctctggagaggcacaagacaggaagagcgaaaggtaaactcaggattattcaaaaggccagactcttgaattcacaaaatacagatgctaagaagctggtatccattgaggaagtaaaaagatgatagagtgatttattcatgatgccttggaaagactgccagactgagggttcaaaggccagaatggtgtattgtcctaccacttacattaaatatccacttgctttgtctggccctcatttttcccgtatgtaaagttggggccaggcacaataatcccagcactttgggaggctgaggcaggtggaccacctgaggtcaagagtttgagaccagcctggccaacattgcaaaaacccatatctactaaaaatacaaaaaaattagccaagcgtggggttatgtacctataatcccagctactcgggaggctgaggcaggagaatcacttgaacccaggaagcagaggttgcagtgagctgagattgtgccactgcacaccaacctgggcaagagagcgagattccatctcagaataaataaatgaaaaataaataaattaattaattaaataaagttggtaggttgggctagattattattcaataattttgcaagatataaatattcaaagatattttttacccaaccaaaaattcctttcagtcttctgtcaacctacaaaaaggatatccttcctttaaaatttatatctagtcctatattttccatgcagcccaatattacaagaaaaacacaagctttgggtcaagccaacttcatctgaaatctcagttctgcttgaaaatacctctgcaaccttaggaaaatgtcagtatccaagtgactccaatgataaattctgagaaatggggttaataataccaatgaaatcagttatgaatagcaaatgagaaaggaggaggtaggactgtctggaaaagacatcatttctcctttttttgtgtgtgcttacctgtttccttgttcacacttttcctgcctctttcttcatgtgcacactgagatctgacttatgcatgcttcattatgtgccatctctcttgatctataaaccagtattttccacctctgtgcctttgctcactctgtgctgcttttcccctctgcctctccacatctcttctatcaatgctccattccaatgttactgtctttagggagtcattcttcattgccccagcccttcttttctgaataagtgtttctatttatgagatcttatttaagttcattttcccttcccattttctgctgacctctaaaacaatattatcaactcttggagatcaggggccatggctcccattcctacccactttcagtgccaaacatggtgcgacggatgtatttgatactcagccagagagattatagaattctgaatggctagaactatattcatgatctagtctagagacttcaaaactcttctgaggaatcctagggatcctaggaagcaccacagcaattgattgcatagaaaaagagggaaactgagcaggcagggctctaaactctcatctctgtttcaaacagagcagtttcacttttatttcttttataggctggccttctatacaagatttcgtgaaaataaagagttctatggctatatcaaaaaccttgaagaagcaaagtgatttgtacaaccgacagggttccttttacatcacagactatgagaatggtatcctcacagatgtgcagtgcataatctgagtggtaaaacatggtaattttatactaagagacagagcttaatccatctggcagcttcaacgaagcctagtaatgtcaaggcaagctcctgcctcagtggaaataggggccctgcgccctgatgtcggggagaaaaaggagagttgtctcttgctcttggttctaggcttgtagtgacatgcagctgatctggaaatggacttgccaattagaaatacaaataaacacagccttcattcattactctctgggccctcaggcctggaatctggcctccaccttttctgtctggctgtcagcaaatgcttatgagcatcagatcaaaggctctgggggaggaagacaaggaaaattccagttaaccaatccttcacagggattaaagaagggtagttactaagacaaacaaaacaagggtgtaaagaaggcatcccagcagctagagacagtcttatatccagacctttcaaaagaagatgatgacgactttttgtagaccagacggatagttttgaggaaagatgacttcaaacttgggagagaatagccgttcggggagaaggtcaagagagagtcagagcaatgaggacactagggactcattagcccacgctctggcctaggtcaacaaactatggcccatgggccaaatccagtccccttccagcttgtgtaaataaagttttattggaacacagccacccccattcatttatttattgtgaatagctgcaaggacagaattgagtagttacaacaaagactctataatcacaaagcctaaaaatattaactaacttaccctttacagaaaaagtttggcaacccctgctcttgacctagtttacaggtggggaaactgagtttcagagaaatgatccaaccacataggaatatggaagtatgatggattaagtaatgtaaaaattgtggaatcaaatgcaccatcaatatacttagattgtgaatctccggggagaaaaaatagagtagggcatcttttcttcataaaatggatttcaaaaactattgaaagaacacactggtatgctgatctagtacaaatcttcacattttaaagaagagaaaagtgtgtcccaaagaaggaaaatgactttccaaggtcacacagtgagtcctttcagcacacaatcccagtcttctaatcaccaatttatcatttaaacgactatcttatgttatctcatattttaaagcacagatggcatgatccccatagcaccttgctatatgcacataatttcactgagaagaaatataacttggtgctaagagtaaaaattcccttgatcaaacaaacattcatagtcattgggttaaatatataactatccatttaacaacacaataatctatagatctttgctagtctgcttctgttcaataaatcttcagctttttaaatctatcaccccttttggtgcagttaaaagcccacaatcttggctgaaaattgcaccacagtagcagtatagaatttacagctgaatttaagggttagttttgccaaaggagggctataatctggtgcaaccccattgaaacctattaccaaaataaggaaagggacttatttctaagtctcacacacttgtattaacagtgatccatttcttagagactgtgtcatgcctaagttatgatctagatgagagttaagatgaaacaccattagccattccattaattattcctctgtagacattacaattgcaaaagctaattgcttctgattcaaccttaccctgtggctaaagtcatctattcgaaaggcaaaccttttattcttctcctgcttaaaacacttccatttcacttcactcctcttaggttaaagaccaaaaccattaagagagcatgtagaaaatgtgggatctagacaacatgctgcctctctagttggatctcttattctgttcctcttagttcagctacaatggctaaatcccttgcatataccctctgcctctctcaatcgtggcacaggctcttctctctgcacagaattctttcttccaccccatctccagccctgccttttccaggctaacttccactcatccctcaggtcttagttcaagtgcccattcctcagaaaagccttccctgaattcctcatgccactaacgtacaccaagattttttttatatatatacagcgtctcactctgtcacttgggttgaagtcagtggcacaatctcagctcactgaaatctctgcctcctgggcttaagcaatccccccacctcagccttccaagtagctgggaccacagacacatgccaccacacctggctaatgttttcttgtgttttttgttgttgttgttgttgttgttttgtattttttggtagagacagcgtttcaccatgttgcccaggctagtcttgaactcctgagctcaagcaatctgcccacctcagcctcccaaagtgctggcattatagacatgagccaccgcacctgacctattaagttttcctattacagatcctgatagcatcctattctctgtatcatctattaatgtctcgagattgtaaactacatgaaggaaaagacagcatcagttttgctgatcccatatccatcttacacagtacctggaacacagcaggctttcaaaaatatttttaatatttgttaaatatatagtaaacatacataacctgtgctgccttatccaagcatcgatgaacctaagagccagaattggtaaattacaaggacgataactaataaatgattgtagtcaacatacaacttcttcccaaagtaaaattagtgctctaatcaaaaggtcaacagatgaatagctgagcacttttccagttgctctgaccctctctaggttttcatgtaggcccttgccattaagtgaatgggagagttaggttaaaatacagtgtctttaacaggccaaggaaaaagaacatttttgaagagacttatcctctgttcacatttcccatccctctgaacaatgcttccaaaataggatcatgtctggtttcaagcccaattcagttccaatgacactacaacccattcatttgagaacctgccaactgaactctcttttttctcctcccaaattcctgctgggtattattttgttgccaccaaaaaaaaaaaaaaaaaaaaagcctcagttgaagtgacaactccttgttgggagggcagccagggcttttcggcaggagatgatggcaccgcttgccctcatccagaaaacaaaacaaagcatcagactaagggcttctgggagagccaaagctgcacggatgtttgttcaatattcggcaacggtgcagggtgctgcctccctagtcagacaggcttgctttggcaataggtttgcacttgaagcatttaaaagctccatagggaccagaggggctcaaattagaaacattaagggagaggggaaaggggtgagacttttatatcataaagaacggcctttattacagcaatggcctcccaggaattactgaaattggatcatttcttaggcggagttactgtctcctgttggaagaaagcaattgctctgaggcctgactcaaggacccacacaaatatctttaagaaggggaaaatagccagctgaaatgccactagcaaggcctgcacttctgtgttgtgcaatatgaacttctcagcctaacaatcaaagtcctgcatcattagtgtgccctttataaataatagtaccaacctaaaagagttattgtgaggattaagtaaggggcctggaacaagttaagcactcaataaatattatttgttattgttgttgttgctgtagttgtcataattacattgctgttgttgttacatgacattaaaattgaaatttctgttcagacaccaaggcctaatagaagtaaaattcccaagtcatgcccctagatgcagaagttacaaaggagaggaaatctaaccaatttcacaactctagaaacctcagccagaacaaagacataaaaagaggttaggccagacacggtggctcacgcctgtaatcccaatactttgggaggccaaggcgggtgaaccacttgagctcaggagtttgaaaccagcctggccaacatggcaaaaccccatgccgatgaaaaacacaaaaattagctgggcctgttggcacacgcctgtaatctcagttatttgggaggctgaggcacgagaatcactcgaacctgggaggtggaggttgcagtgaaccgagtttctgccactgcattccagcctgggtgacacagtgagaacctgtctcaaaaaaaaggaatataaaagaaaaaagagaggtcagaaagtagcaagatttttttttttttttttgagatggagtcttgctgtatcacccagattggagtgcagtggcacaatctcggctcactgcaacctccacctcctggattcaagcaattctccctcagcctcctgagtagttgggactacaggtacatgccaccatgcctggctaatttttgtatttgcaagaagagatttaaggaagtttgttttttgttttgtttttgttttgttttgtttttgcaaagaactattaccatgtttggagtcttcagcaccctagccagctcaagtgttacatgctatctgctaactctaagttttgtgagaggaaccctcaggagtgccacttggagaacttggatatattctcagcaactggcaagaaaatggactaggtcctatcttcacctgaaaaagctgcagtggcctataccaacagaacagaaggagctgcatggggattagcccaaacccccagaggttgcccagtgaaaaatgcttgcttcctctgaactgtatatgggtcacatagaagaaagaactggcctggaactgttttaagccctacccaagaggaatctaacagagtgatgggtcccccacagtgaatctccatgaggtaggaagccagagaaacagtaggtaggaagggatcactgaagccagacaaagagaaatggcactgttccaggtcttacgagaagtcccaagcattggggaccgctgaaaagcccctgaacaagccccccaagacaaatggccagctttataaagatgccaggaccagagaccgcaaagccaggtaaaataattctggagcaagtatgaccttcctaatcctgaccaccgctctttttttttttttttttttttttttgcttgtactgtgaaagaaggggaagaagaggtgcaaagtaaagaaagagcatgaaggccaaccattcccacctcttaatgctcctattgggaaagatacggagattttatttgtcaaaagatttgattaaaatattggactggaaatcctaattcctgatttgaaagtatgttagcaatgtaaaatatcgatggtgctgctgcctattccataagtgataatagattagatgtggtctgctaagattttcatctagaggtagaggaaaattatcccagtaaacatatcacaaagagtggcagaatcaacacatatgtatatacttttgagcatacttgttttcacagactatattttgactattctcaatttgcagtatgaactgaatcgtttatatcctcattatagtacatgtcacgtttttattatttgatttaatataataattaaatgaatatatttctctccaaatataccataagtttcatgagaacaaggaccatggccatttttaatgaacatttgcattccaagcacagagttcactgtttgatatcatgtagacagtctgcaggtaaatatatgaacaaatgaataaatgaatgcataaatctgactcctgtcccactagtgtaatgcttatcagacttcagaccaactatcccaatttatcaccacagccccaaagacagttggtctttgttttattttattaatgtacacttgatagatcagagaagtaaagtaacgtgaccaaagtcacacagctagcaactagtctagctgtttctacccagtttttctgctctttccactgtccatatttcctctctgaaaaactttcagcaccagttttcactcctacaggatgagtcatatccgttccaaatatttgtatcttcccattacctcccacccccaggtaatgcccccaatctcctccacccatttccatgggctaatagggtctcctgggtggaaagcattctaaaggtcacctggtcagaaatcccatctaatttttcatttaccaccaaataatcctccaatttattcttggacatttctaaagatgtggaaatcagtacctttctaggcctcaagttccattgtggaaaggctctattaaacttagactaacttctcatccaggaaccacacttctcatcctaagcatcagacccaagcccagagttatgtactttatgctattagatgtcttatctacagtactcacgcctggactctagttggggtgtggggtcatactacaattaaacaattaactaactaggtagatgaaattcctatcccaggaaccatagggcattgttgggtggcttctgagaaggtatatatgtatgagtatgtgtatgttgtgatgtatgtgttgtgttcatattgcaagcgcacacacacacacacacacacacacacacacacacatttggggaatggaaagaaaagcaacagtggagattccaaaaataagaagacagaattataaaactgccaaaccctaggacaactgatttcctaacctaagtgaatttgcaagctcttcccctaaatgtataagtaataagcacaattacagaggggcagctatagcacagtgttttgcttgagtttaaattccatcttttttgttttctagctgggtgaccttggaacaagaccttaacctctctaagcctccatttcctcatctgtaaaatgctaataattttagtacctaaatattggattatttggaggataaatgagaatcagaacttaatgaaaaatatccaatgctagcgtgtcaagagcatcatcagaggtcatttgttccagcccctggcattcatcctagcattattcaattcttgtacatgtctgaatctgtaaatcttcccttgaaacctgcctgatgctttaactgtcaaaaatttccccttaaattacctgtcttctacctacaagaagacagtagaccagggtagaattgaatgcgtaagtccaaaactgttgagtcagactacctgatttcaaatcttaatcaagtcacttcacctctccaaccttagtttgttcatttgtaaaatggggatactaactcctcatccaactcctctaggaataaaacaaaagatgttgtgctagcacattttcacctatgatctctcacagttctccaccatcctacaaagtagggattgttgcccccttttacaaatgagagaactgaggcacagagtgataaagtataacttgcaagaggacacctgtcttcaagtgaaagcagttaaatttctgaggcaggtcatactctctgtgggaaagggacccctggacactgcccagtagcctagtactggccagtgtcttggccagaatcaggaatcagtcggcattgaagggtaacatttacttcttcctcctgggacaaggcaggttgtggccagtaacaggaggctgaaaaaaaaaggtcatatgtgatctcctgctgccctctagtgcctacttaagatgattgctctggggaaatctctgttctgatcctttcttggcaaagaaggatcattgtgtgcaaagcaacttccactgagggaagccagggaaacagtaaaagctagctatgatacaaggaagcttagtgcgatgagtaaaagaattctgaaagagcatttgctgagaaggcctattcagtgccaggtttacagctaggcacaaggggggaaaatatgaataacaatttgtttcaatccttgtggtactcaagtgtagagacctgatgggacgtattggctgggaaggaaaaaacagagatggagaaggagacgcttaagatatggcagagagaaaagataattgatggagcaggatcttaaagaagacagtaagagaaaaaattccaaggtggtaatggaatggatgcggtctgaacttcatatacatctggatgtgaaattcagttggtcaaaactaggcatgcaaccaggccctctttgtatagttacacaagttgagctctgtaaaaaggtgactcactcataggtgggaattgaacaatgagaacacttggacacaggaaggggaacatcacacaccggggcctgttgtggggtgcggggaggggagagggataaaattaggaaatatacctaatgtaaatgatgagttaatgggtgcagcacaccaacatggcacatgtatacatatgtaacaaacctgcacattgtgtacatgtaccctagaacttaaattaaaaaaaaaaagaaaaaaatatatatatataaaaggtgacaaggcaaaagggtggatggggactaaatccaccctcagcttcacgtgccatgcctgtgctcctgcaattgagtacaagtagaggagctcctcttcctaattcatataagaggtaacttacaggctagccacagccctgcatgtgaccatagacaagcttcttcctcatagtagtctctgctttttatgtataaaataggcgaatatcaccgacaatataaagttgttgagatttaagataacgggctgggtgcagtggctcatgcctgtaattccaacactttgggaggctaaggtgggcggatcacctgaggtcaggagttcaagaccagcctggccaatatggtgaaaccctgtctccactaaaaatacaaaagttagctgggtgtggtggtgggcacctgtaatcccagatactcgggaggctgaggcaggagaatcacttcaacctgggaggcagagtttgcagtaagcagagattgcaccattgcactccagcctgggcaacgaaagtgagactccatctcaaaaaaataaaaaaataatgtagggtcatgccagacacttaatagccacccaaaacatgccagttcttgttattattactattattagtattattctaacaacatagtcttatttttaatgcagttttgcttttaagatggtgataggaaaagtgcttggtaaagggagaagacagaaaagaaaatcatatttcccaatcttctattctttgccaaacacaagacattgtggatctcatggaatcctcacaacagtgccttggacaagtaatgtcgtaattttttacaactgtaatatacagctgaaaaaacagagtttccgagaagtgacagactgcagtcgaaggtcattaggcattcaaagactgactccaaagccccttttctgtccaaaggagctgagatggatcattaataggagaacgccttctctttcttgggatcaagttcttttactttcttgaaaactgtgtttaaaacttactcctcaagaacggattccaagattagttccttcccaattccttcctcctccttccaatcacttctcaggctaggggtcaaagaggaaatgctcagaaaagattattcttggacaaggcttacggaattggaggcctctgagatgctaatgacctgctttagataaagactcccagattgtcccacttgaacatatttgaagcaggagagcagaccaacaaggtataccagcccaccttggggccagtaggaggccactttggggccagggggaggttgccagtttcaaacatccaggagggtatgaacatcagctggagtcatctaggaaccattagtcagttaagggaaccattagaaaacactctcttactgttttcctgggggttcacagtcttgctttcacatttctaactatttttaacaaaatgttaaaaatactcatgttaaaagacaacctttaaacatgttaccaggcattacttttggaaaacatgttcaagattgagttacttctccgttagctcccctctgcggtgtaactctgctgctaggggcagggagaaggatcaatgagcccactcaacaaaatataaaagggctgaaactcatagagatttcctgtcttatattgaggcaatcagtaaaattaatattaactgtagctgcagttttacaggcacatattccaggacagatgttctgctacttgatttgcatacattatgccctttggtctctataaatcctaacaatgagaggtaggtttcactattgctttttaaagatgagtaaatggaagctcatggagggaaaatcagggatccaagaacatctggattgccattgtgaccttccttatttctaagcactcttccacaatattaggctgcctcccactctgctacattgctagagattcaagttcaggcagttataaattctggaaattgaatattcaatttctgttgcttctgcccattacatcacagtaatcagcaataaatctcttaccatagcagtctatggacaatcaataggtaattggttgaaaaactatgaagcatccaaacagtggggtactatatacctaaaaatgaattagaataatattgtatgtgattggagtaatcacaaatatattttactaaatggaaaaaaggaaagtgcagaacagtgtttaaggttttttgtttttttttaatataggcacagggcctcactatgttgcctaggttggtcttgaacttgtaagctcaaggaatccaccctccttggcctcccaaagtgttgggattacagtgtgagccaccatgtccagcccagagcactgtttagagtgctctcttttgtatagaaatatatataatatatatatatgtatatgtatatatgtatataaattttttattaggaaacactgacaggttacccaaacctaacacaatagttatctacaggggaaacaagaaaacaaggtccagggataagaatagaagccagagttctgcagtatatcttcatttataagttttagctttgcaccacacaaaagttttacatacttttttttaaagcacaaaagaaaaaaaaaaacaatctctacaaattatatacccactgaaaaaatatctctaactctacatcagtgttgacataattgtttagagaaaataacaatttagagtggcttttaaatgcagtattttgattttacagtttagtgaggaatattccaaacacaaaatgatctgcgaatctagacttaatggtcttatcaccagctgtaatattggtgatatagcttggatgtttgtcccctccaaatttcatgttgaaatgtaatccccagtgttggaggtgagacggggtaggaggtgtttgggtcatgggcatggatccctcatcaatggcttggtgctctccctgtgataatgagttacttcaagagctgattgttaaaaagtctgggacctccctccctctctctttcttgctccctctctcttgccatgtgatacacctactcttctaccacgttccaccatgactaagagcttcctgaagccttaccagaagctaagcagatgctggtgccatgcttgtacagcctacagaactgtgagccaaataaaccttttttccttataaattactcagtctcaggtattgctttatagtgacacaaaatggactgacacaattggtattgctattttgaaataattacctgtctgttgtgggctatagcaagtaagccattacgttactgtgattgggaactaagctttttcagcattacggacaactaattcaggtattaagaaggtttatgaaaaattatgtaaactgaaatttcagttggaaatcataaaaacttacgacttgtttttgtctttgaaaaaataaaaacatttcatagctctgcctactgaaaaggcctagaaataatgataatgtactaggcaataaatacccctactgcccagactctggtttctaaatgctatttttcattaaaaggaacaaaggatacttggaaaaattcctgaatccaagtctggaacaagtatggtacaagctgagcctgggatgttttgttgtaacaaaaaacaaggtcaggactaatgaagtcatttcaaaaggacatacaaaccaacttaaagggaatcacattggcctaacattaaacaatttgaacaaggaaaacaataataattgcaattgatttaaatttatcaaacaaatacacttccattaattcataatgttctgaaaactgaaaccaaagccaaaccaaaaccaagaaacaaataaaaaccaaattaacaaagctcatcagttactactggagactgctaggagacaaacatattattctaaaaattgataaaagaatgaagtatcagccatgctttgaactggatttcagggtaaccatattttttatggaaatactgcaggtaataagagcagtaataatgacagaatcacaaaattaccatttcataatttctaataaaagaatagatctagacaactatcatcaatgaatcctaaaactgctaggagaaaggctaatgagaaaatttctaatgaatggattggactgataggtactgaacttactgatcaaacctaatgtgactacaagtagtacaacaggcattaagtgccactgatatgattctctaagatgtacatggcactgcctgagtaattcaggtggtactccttggatgatagaatttgggggtctgcagacttgtatagggaaaagaacatacctttatttttagtatcttatcattgcaatgtactatttccttaaattatgaatgccattaacaaaacatagtagtatgaacatttcctatgactttgacataatgaaactcacatatacttctatcacattaccattattacaaatctaaaaatacttgtggttgaccaaacttagaattatgatagactgtccgctagatcttgtcattaataaagatgcacatatattactgtatcatacttttaaaatattttgatagttatatattgacataatttctttcttttatagtcttttgtattttattttatgcattttaaaatgtttttctgagaaaaggggttatagtcttcaacattctacaaaaggagcctgtaagacaaaaacaggtggtgaatccctaaaaaagagaaacaaattaaacaacaccatgaggaaacacttagctaaatctgtaatttgaacagttctaaaggacaaatgagccaacatcttcaacaaataacagcatgggcaaaattaaagtgtggaactattatagattaaaagaacaccatatagacattttgatccatattatttatttatacttatttatttattcttttttttttttttttttttttttgagacagagtcttgctctgtcacccaggctggggtgtagcggtgtgatcttggctcactgcaacttctgcctcctgtgttcaagctattctcctacctcagcctcccaagtagctgggactacaggtgtgcaccaccacccctggctaatttttgtatttttaatagagacaggagttcaccatgttggccaggctggtcttgaactcctgacctcaagtgatccacccacctcagcctctcaaagtgctgggattacaggcgtgaaccaccacacctggccttgatccgtatttaaatatacagactatgaaagatatttttgaagcagttaaggtaatttgaatatgaaatgctagatgtgataatgatgttgagcttatgttaaaaaaaactatctgtttgcaatatacactgggatatttacagaaggaataatataatgctgtatctgggatttgctttgaaagactctagcaacaaaaaaacaaattgcagataagcaacagctgaagcaaagttggcaaaatattgacaacaattattgctaggtgatgaatacatagagatttattataccattttctctccttgtgtgtacttaaaatcttccttaataaaacattgagaaaagacggctgccagattacacaaaattgaaaaggaaaattattgctgggaaatagaatgaggggagatttttcatattctacattatgtactgttttgattctttcttgtaaatgtgtgctcacttgtattgttttttaaagactatttttagaacacctttaggttcacagaaaaactgaaatgaaggcacagaaaatttctctattttcatgcccccccacccacccacctgccacatagcttcccctgtcatcaacatccccaacagagtggtacatttgttacaactgatgaacgtacactgacatatcataaacacttgaagtccaaaatttatcatagtaatcagtgctggtgttgaacattctatgggtttgtacaaatgtataatgacatgtatctaccactgtagtaccatgcagagtattttcactgccctaaaaatacggtgtgctccacctattcatccatatcccctgctcccaactcctggaaacctggaaactcctgaaatctttagtctccacagttttaccttttccagaatgtcatacagtgggaatcatacagtatatagatttcagattggcttttttttttttttttgagacagtctcactctgtcacccaggctggagtacagttgcacaatcttgggtcaccgcaacctccgccccccaggttcaagcgattctcccgcctcagcctcctgagtagctgggattataggcacccgccatcacgcccggctaatttttgtatttttgtagagatagggtttcacccatgttggccaggctgaccttgaactcctgacctcaggtgatccacccgcctcggcctcccaaaatgctgggattataggcataagccaccatgcccggccgccttcttttacttactaatatgcatttaagcttcctccatgtattttcatggtttagaagctcatttctttttattgctcaatatagtacattgtctggatgtaccacaagctatttatccattcacctatgaaggacatattgattgctctcaagtttggacaattatgaataaagctgatataaatatccatgtgcaggtttttgtgtggatatatgttttcaactcctttggacaaataccaaggagcacaattgcaaagatcacatggtaagactatgatttaagggacatgagaggaatgcagtattttgctaggacagatgtaaggatggctgggcttagtgggctagaaatgacttagtgtgtcggtcagtgaagacagggaggtaggaggtgagactcaaccccagaggcagagactcaggcaccagaccagattgaggactacctaaaacagggctagggcagaagcagctttccataatatgtacccaacaaagtgtcattgaggtaggaggtgagactcagctctggaggtggggattcagacactggaccagattgaggactagctaaaacagggtcaggcggaagctattttccataagacatgtccaccagtgtgccatgtcagttcaccattgccatggcaacacctaaaggttactatctttttccacagcaactgtcccatgaaccagaagttaccacccttatcctaggaatttctgcataaatcaccccttaatttgcatgtaattaaaagtgggtataaatacgtctgcagagctgctactttggacacactgcctatggagtagccctgctctacagagcgcaggacctatgctgctgctctacacttcaataaaagttgctatctaaaaaacaaacaaacaaacaaacaaaacagtacatttaggtttgtaagaaactgccaaaccaccttccaaagtggctgcgcattttgcattcctaccagcaatgaacaagaattcctgtggctctgaatcattgtcagcacttgatttgcagcatcttttcatatgcttatttgccatatgtctatcttccttggtgacatgtatattaaagtcttcagcccatttttttatttgggctattttcttattgttgagttttaagagctctttatatattttggataacagtcctttattggatgtgtcttttgcaaatactttctcccagtctttggcttgtattctcattatcttgacattgtctttcatagagcagaagtttttcattttaatgaaatccagcttatcaatgattccttatgtattgtattttttttttttttgagacagagtcttgctctgtcacccagtctggaatgcagtggtgtgatcttggctcactgcaacctcaacctcttgggttcaagcaattctctgcctcagcctcccacgtagctgggattacaggcacgtgccaccacgcccagctaatttttgtatttttagtagaaatggggtttcaccatgttggccaggctgctctcaaactcctgacctcaggtgatccacccgccttggcctcccaaagtgttgggattacaggcatgagccaccatgcccagcctgcactacttctcataaagccacccatcaatcaaaaacatctatttgggatgctgaacaaataaacaaaaaaaccttgattgtattaagccactgagatttaagggtttattgtttataacagctagtattgtcaaactatgtaagtacttagaacatggtaaggaatcaataaacgctagtaatcaccatgatgatgatatgatgatgatcatgatgacaatccccccggacaaagtgtccacaagggcaggaggtagaagggctggtcaagtatgactgagtggctgggccaggggatcacagcctccccaagtgctgggattacaggcataagccaccgcacctggccttatgtattgtatttttaaaaagcaataacattttcctattcttcaaaataaaacagaagaatagataagcagtgacatgaaaataatatgttgggtagaggtgaggggttgggtaaaggagactgtctctttgtctgtggccaggcagtcttacagatgtcagttgatggagtggttaatggcagccaccataaagaggaaagctggctgaaatactggagcaaagaggagcaggagatctgggactggggctgagatgcagggcttggcagaaattaggcctatgagaaattttcccagcagccttcatttagcattaagttgagctgaggttgttagcactgcatagggaatcttctcttggcaataacattattattattatttctgacctttgactatccatactagttcaaaccattacaaattggatctggtcaatgaacataaatgtatatgatattaaaataaagcttcaaaattctgaaccagttgtttccatatcaactcaaggaaataaactagaaaggaaaaaaaatgtatctgcacaaggacatttttgcaatcttatttgagctagttcaatgttcaaagttgggtctgtcaactcttaggtaggcagtttgacaattataaaggccagtaaaaaattatttcaaacatttttcatattaagtaaataaaatcccaaaatttatattagaaaagaaagtttttgaatacctagaattattatagatacgtattaacagagtaagaggaacttagtaaatgtttacaattagataaatataaccatcataatgattatattaaggtggttgataaaactgactcttttaaaatgctcttttataatttaaatttaaattgaattcaaacatctattgagcacttaccaagtatcaggtataggctagactgaaaaatttgggggctgggtacatcatatggagattagagtcagaatttcagcaaaaagtagaactaagtaggccaacagataataagaaaaggagggaggaaagaaaaagggatgaagagagagcaagttggggtggggggaacaactctaaaatggccttcaacaatcccccctcctcatatttactacctcctccacttgagttacttgctcccaagcaacagaatatgacaatattgagaggatgccacttctgtgattaggttacaaaagaggtaacttccattgtattagactccctcttgctggctttaaaaaaaaccaaatgagtcatgaagaggctcatgtggcaaaggatggagggcagtctccagccaaaagccagcaaggaactgaggactttggtccaaccacccttaaggaactgaatctcatcaaaatatatatgtcatcttgaaaatggctacttccccatttcagccttcagatgagaccacagcttctgccattaacttgattgcagttttgtaagacactgtgaagcagagaaacgagataacctgtgcttggattcctgactcacaaaaactgtgagaggggaaaaaaagtgtgttgtttcgagtggcaaaattttggaggtaatttgctatataatgacagataagtaacataaatacataaaattttatattatttcataaaaattctagtgctgggcacagtgactcatacctgtaatcctagcactttgggaggctgaggcaggaggatggcttgagctcaggagttcaagaacagcctgggcaacatggtgaaaccccatatctacaaaacattacctaggcatggtggcatgagcctgtagtcccagctacttgggggactgaggtgggaggatcacttgagccagggaggtcaaggctgcagtgagctgagatcatgacactgcactccaccctgggtgacagaatgagatcttgtctcaaaaaaaaaaaaaatctagtaattataaacttctagactcagacatatttgttaggttgtataagagttttaaacccttacattttctctcctatattctcttcctcctcagaattcagttgccaatgagagaagaaaatgagactattgtgttgagaatagtaataacaataataacagtaataataactacattaacagctaacatccacagagcacatattctttaccaggtggtgccttttggatttattaagtcatcaaacactcacatttctgtgtggtagatgactactattatcccccattttgcagaggagggaagggaagtacagaaggctaagttagttgtccaaagttatagaacttgtcagttgcaaaaagataccaagaattgtttcaaaatatcttttcatctcttccttaaaatacccttccaactgggtggtgttggggttctgtctgattacaaagccctcactttttctagataatggtgtccttaataagcaaacttagtttatattattaataataacaaatgcaatataatgaacattactccatattaggcaaagtgctaaatgttttacaaccaattgagacaagaaaacagggtctgaaggcagggaacataaggctgattcccacttaagctatgacaggaaatatcctctccataggtagggcataggccaagtaaataacttcataactttacttcatcctcttcatttacatagagcatacacccaagtaaccaatggaatcatctagagggtatttaaactccccaaaattctggcccctatgcttggggctgctcccacactgtggagtgttctttcattttcaataattccattcattccttccttgctttgtttgtgggttttgtccaattctttgttcaagccaccaagaacctggacacaattcaccggttacatatctcatcttgctcccaacaatcctgtgttaactattgttatccctattttaaagacaatgaaagaaaactagagatcttctttataaatgaagaaaacaatattaagctcaaagggtggtgttatcagtggaattgtgtcctcccccaaaatatgttgaaagcctaatctccagtacattggaatgtgaccttatttgcaaatggggtgattttagttgtaactggttaagacaatgtaatactggagtggggcaggtccttaatccaatatgacagatggctttacaagaatgcgtagacatatacacagaggaaatgccatgaggaggtagagattgaagttatgctcacacaaggcaaaaaaatgcctggggccaccagaagttggaagaggcaaggaataatctctctctagaagttttggagagaatatggccctggtgacaccttaatttgagttttctatgctccaaaactgtgagagaataaatttttcattttaagccacctagcttgtggtactttgttactgcaaccttagcaaactgatgaagccacctttgctaaactatgactgagatagtgaaagagatctaacttaactgactccatcttgcttctaacctccatgctgtccttgttcattcctgggcataggctgaactaactttgggagaaacttagtttgtagtttatagtttaaagaaaaatggtaacagctctttccaaagcagacctccttcttgcctggggactagattgcctttgtaggactaacattagccacagattagaaattatggtttaggagtcatgcagctggaggttacaagatgctgaccctccctaaactgctcctgagatcagtgcttgagatattttgcagaccctgcacttgatggatcagctggcactacccaaatcaatacttgccaggttctgacccacagaccccagctgcatgacagatgaataacgtactcagacactgatattcagtgaaagagaggctacagggccaggccacacacagagttgtggcaatcacacactttgattagctggccctgccggcatttattcagcacagatttaatgacaaaggctttgagtcaacacacctgtgggcaattaatctggtcgccctcccccggagagagccatcctgcccacaaatgatcaaaggttggttttaggacaatgggagtaaacaagctatttagataaacttccccacattcccttgttatttgcttttttgctatcaactaaaggtaaagaggactaggctgccttcagccaaatcttttactgaagctatgcaatccccctggccttccaagaaggtttgtgtctatctcctataactatatctttataattttctccaaccaccctgaccaatcccctacataaactggctcatctgatcttgtggccctggactcaggaactgactcagtgcaaggagacagcttcaactccctatgatttcatccctgaccaatcagcactcctggctcactggcttcccccagccaccaagttatccttaaaaactctgctccccaaatgctcagggagactgatttgagtaataataaaactccagtcttccacacagcgagctctgcttgaattactctttctccattgcaattcccgtcttgatgaatcggctctgtctacgcagtgggcaaggtgaaccccctgggcagttacaaattcaggggcttgtccaggattgcccttgtggctacctgctcatggttcagtgcccccccacgctccagcaatggatccagaggccagcccaagtggctgcctagttcttttggactggggctgactctggtactctattggtggggtactgctgatccaatgtgcaaggatttaattgcaatggagaaataatcctggggagatatcccttaactgtagccctatcacagggtgtcagtctgtagctccattgtagggtgtttggattggtgactatcctaggtgcttccaatgcctccttccttctcccagctggtctgtagccctatggtggggtgtctgtagccccaatgcagggagtctgtttatagctccaccatggtgtgtctgcatctgtagccccattgcggggtgtctgtttggctccttccaggggttcttggttagctctttccaactagtaggaagagtcttggtttgggagacttctcattcaggaggatttcgaggaggattctcagatggagaataggaggatagtttggaagggatactcttggagttcttgatcagggatctgatttggaaggccttctgtctgtcatgtctttctgtgtgtttgtatatgtgaaggggatctcagaaggaattgctgctggaagtccagcaggcttaactcagagaaccctccttatttgtctagttacatttggtgagccctaaagaaagctcaacaggcctgtctcagggtgaccatctgctcttggccttgcccagagaccccattgtgaattgccatttagaggtcatgccttcccacctggagtggatcaaagacaacagggaccaacagggaaaaagtttgagctttgccaggttgacattgcgtgctgaacaaggtgactaatgtctgttttgttatgtgtattttgctgggatgaaaaattttaattcagttccctaagcagcatattgggcagcatttgcaaattaagaatcttgtctatggttccataaaacagtaaagggtgattttctcttgtaaagtggcttgacccccacagctatagcacaagagaacagggtcacgagaagccgctccgttcttctggaagctgcagagaaaaggaaactggaaatctgatatgccagcaaaaagggtaagaaattcttaccagccaaatttctctctctctctttctctgtctgggtaaacagtaaactatttgtctcccctgcaagggtttgattaatagcaaaaaggatttgtgagactagtcttaggccatagcaaatctggtgtactttgtgctaagaatttgtctttctgtgttctgtaatggagagaggggtatcacaggatagaatgtggatttaggatccctacaagcctgcttttcaaggcagtttggcaggctggtcagttacaaactttgctacaggtccctgaaaccaacacagtacaaaattcctctgtcttgttttgtgtccttaagagctcaaccttgtgaccatatggggatactttcttttggtttgcactatccagaagacagacatttgtgggctcatgtcatagttagccataaaaattttttttgagcagttaaaagccttgcaagcttgaaattggcttctctaggctccttctaggaaaagcaatagaaactgctcaatgctgtacagctcagtagccaaggctttatcttttgaaagtggtggcctgggttcaattgttggcttctggaatgattcctttctggtttgttattagtgtagcattgccatttactgaggtttttccccccatggtagtttctgatttcctctcttgaattttcctttttctgaactaccttgtggaaattctaaatcttgtaaaaaagaaactacttaccatgtctttgaagcacctaggaagttacctttggtaaagtttagaagctacaaatattggccgcttggcatggctaaagccaggtaataagagatttgaaatgattttttttaaagagcactatggttaaaagtcagcttaattaaaagtggataaacaaactatagatatattttaaaagcctttatgtttttctcttcttggaacttgtttttctggaaaaaggtttttttcccttctcagtctactgaattatttttctccatttttttgtcttgccactcttaatgcatacatgagaggcactaagataacttctcatagcttgggactccttgggaaagacagaggaggcaccatagaccctgttttggaaaaaaaaacctctgttttcttcattaaaatctagtaattaaaagtggatggatccctctcaaaatcaaacactctgttctgttttgcattgtgttatctgacagttttgagtttgggggtatcagaaattacttggcattatgagagagctttggtttgtaataactaggtaggaaatatactttaaggaatggctaatagcacttatggagggatacttgactttttgcacacttggatcagagaagcatgctattggccacctggaagataaggaaacacccccaccccccactggaagatgagactcccaagagagatgggctgattacaaaatgggctgattggctttgggttgccttgcaatgaaatacagggtagaagcactgcactgtcttctcccatagtatttccctccttttggggacccaggatccagtataaaatgggacccttaattttgggtatctgtctttgcgttcagctgcttatttgctgcttatttggccctagaaaggcatgctttcctggccctcttcctccaagggcttcaccctgaagccagtaatccaattaagaaactgggaaatgaaaaatattacaagtgctgaagcatctgtccatctgctgtctatttatatgtgttgtatgtttatatctaaaagagctctgattaattggcttagaaaaataagcatttaaatcaaatattttatcagaaaaatagaaactttaatgcctttttgttcatatgacttcagtaatcttttggaaataaagacagttttaaagattattggtaaaatgtcttaaaaatatagacacttgttctaaattaaggtcagatatcagatttgttaaatgcttaaggtccaactgtttccttgacttttgaaaattgttcaacttacctactttggggcattagattatagataaggcctggggacaaatggagagccatgaccaacatctacaataaaaagagtcagaccttatcgtcacttctgtctgatgtcctaggctccacccctagtacataattaaaatcacttacttatcaggtttttcactaaaaataaaagttgctaagagttaacattgtaacatgttattgagaccactggagaaacagttttacatataaggtgtgtagggaacgtgtttttggtaaaagattataagaaggcatggagatacggcttttgttaaaaggaatgtaattttgtctagttcagagggttttaaagattgtcttaacctacaagtgtaatggaacaaaactgaaggttaagcaaagtgaaaagggcttataaagggttgatcttgtaaaaaacattctgtgggtataaacaagatggctaagatttgattgaaattatttagctttttttccatagattaaaacattaaaatcatactcatgtggggccagaatctgggaccatgtgtctgaataaccaggttttcttagaaaattgatctgtttgatagaaaattgtaaagagttctaaacagtttatgaaaatcttaccttatgaccaaactaattaaaaacggatataaaattttattttaaaaagtagttttaacattaaagatgcactaatgcaaacatgaaatttggttttctcttttgaagatgattttcatgtaatgttaaaagataatgaaagggtttcgtttttccctctgggtaaatggcaggcaagacagaaaagagacaaattcagttagcctcatgctatctttattgggtcttatttggaaagctaagtctcctctatcagagtaaaggtttttctttttaaaaatttttgaagttatcattttggccaaatgaattagttatggttatcattttagccaaattgatgacttatggtaacctgggattctattttataatatccagtgttttaaacctttgttatttgacaaactttccaaaatcaaattataaattatgcctctttctagcctaatcttttagatattaaatcctgtaaagtccaaaaatgacatttggcttatttcatatgaaactcatacaagaagcactgtcaaataggaaatgatgtttggctttctttggaacatttgtgtaaatgtgttactggcgtatgttccgaaattatgtaaaactcctataattctaatatgacttagtatatgttatcagtaataattataattattatgttaaatgactgtgtgccacagaggtaacaaattcccttgtcaattgtgtcttcaagtgtggctgccctcaccacaccacacctattccaaaattgaccacatagttggaagtaaaactctcctcagcaaatgtaaaagaacagaaattataactgtctctcagaacacagtgcaatcaaacttgaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcaataaatgcccataagagaaagcaggaaagatctaaaattgacaccctaacatcacaattaaaagaactaaaaaagcaagagcaaacacattcaaaagctagcagaaggcaagaaataactaaaatcagagcagaagtgaaggaaatagagacacaaaaaacccttcaaaaaattaatgaatccaggagctggttttttgaaaggatcaacaaaattgatagaccactagcaagactcataaagaagaaaagagagaagaatcaaatagacgcaataaaaaatgataaaggggatatcaccaccgatcccacggaaatacaaactaccatcagagaatactacaaacacctctacgcaaataaactagaaaatctagaagaaatggataaattcctggacacatacaccatcccaagactaaaccaggaagaagttgaatctctgaatagaccaataacaggatctgaaattgtggcaataatcaatagcttaccaaccaaaaagagtccaggaccagatggattcacagccgaattctaccaggggtacaaggaggaactggtatcattccttctgaaactattccaatcaacagaaaaagagggaatcctccctaactcattttatgaggccagcatcatcctgataccaaagccgggcagagacacaaccaaaaaggagaattttagatcaatatccttgataaacattgatgcaaaaatcctcaataaaatactggcaaaccgaatccagcagcacatcaaaaagcgtatccaccatgatcaagtgggcttcatccctgggatgcaaggctggttcaatatatgcaaatcaataaatgcaatccagcatataaacagaaccaaagacaaaaatcacatgattatctcaatagatgcagaaaaggcctttgacaaaattcaacaaccttcatgctaaaaactctcaataaattaggtattgatgggacgtatttgaaaataacaagagctatctatgacaaacccacagccaatatcatactgaatagacaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgcccctagttgcagatgacataattgtatatctagaaaaccccattgtctcagcccaaaatctccttaagctgataagcaacttcagcaaagtctcaggatacaaaatcaatgtacaaaaatcacaagcattcttatataccaataacagacaaacggagagccaaatcataagtgaactcccattcacaattgcttcaaagtgaataaaatacctaagaatccaacttacaagggacgtgaaggacctcttcaaggagaactacaaaccactgctcaatgaaataaaagaggatacaaacaaatggaagaacattccatgctcattggtaggaagaattaatatcgtgaaaatggccatactgcccaaggtaatttacagattcaatgccatccccatcaagctaccaatgactttcttcatagaattggaaaaaactactttaaggttcatatggaaccaaaaaagagcctgcattgccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaaactgagaataacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtggacgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaaggcaggaaacaacaagtgctggagaggatgtggagaaatagcaacacttttacactgttggtgggactgtaaactggttcaaacattgtggaagtcagtgtggcaattcctcagggatctagaactagaaataccatttgacccagccatcccattactgggtatatacccaaaggactataaatcatgctgctataaagacgcattcacacgtatgtttactgtggcactattcacaatagcaaagacttggaaccaacccaaatgtccaacaatgatagactggattaagaaaatgtggcacatatacaccatggaatactatgcagccataaaaaatgatgagttcatgtcctttgtagagacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtggagggagaggggagggatagcattaggagacatacctaatgctaaatgacgagttaatgggtgcagcacaccagcatggcacatgtatacataggtaactaacctgcacattgtgcacatgtaccctaaaacttaaagtataataataataaaataaaataaaaaataaaaaataaattaaaaaaaaaagtgtggctgccctaaaatgtttttgtcatccatatacaattgttgtctcgctttggtcctctttaacggatggttttataatcagctataaaatttaacaggccctcttaaatgcaggtttctgattaaaaactctggagactgtgatattagaatcgaggaaaaactttcaaattgaagagtgaatagtgtttggttttctttggactatatttgtataaatatgttattagtatgtgttccagaaattatgggaaacttctataattctgatatgatttagagtacattattaataattataattgttatataaaagtgttgtatgccacagaagtaaccaagattcctagtcaattgcagctttaatagtagctatagacttttgtcatccatagacattttgtcttgcttttgtccttttcaaaaggcagtttataatcagatatcacactctgagtgcaggtctcagataactttaaaaattgttttattggaatagaggaaaaaatgaaacttctaggcttctcacagatagctgatgtgttaagcattgctaatcctctcattttcagagtcaagatagcatatttctttagagttatttgcaacttttaacaaatgagtaaaaaatacttccatgaaaaaaatttagagcatatttgtttctctctacctgatttctcctgaatatggaaactatttgtaagtattctcaatttatgccagtatacttaattgcataagtgcagtaagaatctgtttttgtcttgtaacaggacacaactggagaaattgattattttaccaaggcttttactggaatggcatgcttccttcaaagaatcaaaattaatgtatagagccaattaaagccccctggggaatctaacctcagaccttgtctatagtccctgtacaaggttctgtcatacagtccctgtacaaggttcctgacctgtggtaagtaaagaatgtcactttctaacaggcccaggaaccccaagttattttgggaccttgagaagagaggaatttacccaactcataggtatttgaggatacaaacccatggctgagcttggcttttaaaaactcttatctgagattcctcatggaacagagttccatcaaagctaatttaaacaaaaaagaccctaagtgaaaaataattattcttgctgcactttatgcaaataatcaggccaagtatagtaagactaaagtacatttctgtaaacaaatcagttctatcatgatttgtttttaataaaaatggggtctggagagagagaaattatgcttcaagaggaaacctattgttagctgttgttagctgtccttgagttttttctacaattttgactaaatcctaaattatttgtgggttggaagtcgccagactaatgctttcaaatctttgcttttaaaattgagtattgtactcctcatcctaggactcattatttaccttatagtaggctgttcacctaaatactgtactaaaactatagatgagagtactaatgtttttgccatgcaagccttagaagcccagccagacctgcatgagtcgctcagacacttgaaagtggtcccactcttctcaccttggggttgactcccattcccactacgtcccctgtcagcaagaagaacccagagcaatcgacagccttttcccatcttcataccctacactttaagattaaggtgttacaaaacccaaagtgatggactgaaactgcctttgcaaaattatgattgagacagtaaaagagatctaacttaactgactccatcttgcttctaacttccaagctgtccttgttcattcctgggcataggctgaactaactttgggagaaatttagtctgtagttcatagtttaaacaaagacagtaacaaccctatcccaaagcagacctccttgcctgggtactagattgcctttgtaggactaacattagccacaagattagaaattgcggtttaggagtcatgcagctggaggttacaagatgctgagcctccctaaaatgcttctgagatcagtgcttgagatattttgcagaccctgcacttgatggatcagctggcaccacccagatcaataaactcactcatctgatcttgtggcccccccactcaggaactgactcactgcaaggagacagcttcgactccctatgatttcatccctgaccaacagcgctcctggctcactggcttcccccaacccaccaagttatccttaaaatctctgttccccaaatgctcagggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaattttaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtccctttccatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagatgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccattgcaaaacttgtgaatctacagaatacttttctgaaaaccactgaactacagcattgcttaccttatagttctgtcttattagtcatgtggccttgggcaagtcatttaactcttcctcttctggaaaataacaaaaatgatccctgcctcctagaagggtatgagataacatgtgaaaataacctggtttcattcctggaatattccataaatgatggctgttactcttttatctagttgctcaaaagagcacctgatggtgggaagtggtccaaccatgctaaacagttcctttcttcttgcttaacaggtttctatttggtgattaaaacctttctcaggcatttctttcccctcacaagtctccaaatatatcaagttcatctcttcctttctactgtctatttcacattcctattatataaatcactgtgttgcaattatctgtccatatatttgagctttattgagggctaactaatctagctaccagcatgtaacatggtgcctagtatagaatatgttatcagttatttaattggttcaggtatttacctgacttaatgggactccagtaacccgagtcttcctagtgtagcccccttagattagataaaaaaggatactcagacaagcccttttataaggtgtttaaaagctagtggcaaacaattgacttagaggttggttaagcccctcctccctttatcattctgagtggttacatagaatttaagattttggagcaatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgattcgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccatgttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggagtggggaggggtagcattgggagatatacctaatgctagatgacgagttagtgggtgcagcgcaccagcatggcacatgtatacgtatgtaactaacctgcacaatgtgcacatgtaccctaaaacttaaagtataataataaaaaaaaaaaaagtgcagtgttactctactctgtaggagggaagtggaagggagaacctagtatgagactcaggtctccaccctgcacttgactaggatgctgatttgcactcaggacatgcagcccttcaaggcatctcaaattacagacatgaaacaacagatgcctggatgaattttacaagcagggcaacagtgaggaagaaggctgtgtagcaaaatatacacttagactccagacctatggctttatcttgtcaatatcattaatattcacgggacccaagctaaggctgaagttagtgagccagctctgggtctggcaatgtactctagtgagaagatcaccggccttgaagtcaggcttgtgtctgaatcacagctctgcattttaactagctgtgtgacctcaggtgatcaccatacctctgagcctcaatttccctatctgttaatttaaataagggtgttggtatgtcaccaaaatcccttctagctctaagattttaattaatttgttaaccaatggaattgttgagttccccccaatgtttttgcataatctttgttataactgtgttttgtttacattagaatagtagaacaacaacatcaacaaaaaacccaaatcatccccaacttgatataattgcttctctaccccagctgttgtgactttgtgtcacttagctgttgtcaccctgctgagctagagttttccttggtaaaagaaaatgaatgacagtttatgttttaaagggctgttgtgagaattaaaatatataaatgggatagtatatgtaaaagtacctaattcagaaaatgtgtgacttccattatagggggcaaaagcatccttcccttcatggtgagttgttgatacacattcaagtgaaagccagtggagattttcagacctgtattggtgatgcaatagcatgttcagcacttcttggcctcttaattgaaaagcctattggaggaagagtgggattgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttagatggctagcttcaaagaattttttctctaggtcaaaatttattaactcaaataattataaaaataaaagtaagccacaaatatccctgttaagtggttaaagcttgagctttgtaagcagggagtcctgagtttagtcctgtttccctcaattattagctctatgaccattaagtcacttaacctctcagtctgttttctcactagtaatgactgtttcacattttattgcagtattgtgaagagatgatggatatataaatgccatttagcagaataaaaagcatttttgaaattacagtaaaccaaatatatctgaaattacctcatttttgtgatataaagatgatatgaaactggtaagggaaagtctaacccctgcaaccgcaaaggaaaattatttactaactcactgaaatcttgattgaaaccatgaagagtttgtgtgaatgtatataagtcaaatgcatgttttccctatacagataaaaccaggattttcttgtggtgatttacccagtttacctggttataactataatggcattgcatattgtgaaagaatatcaaaacctgagattccatttattcactcacttattaaacatatataagacatctaccctttattattattagcaatacttaatatgagtaatgaatgcaaagaaaatcagtcatgaattttgtagtcaagtagcttgtggtctggctgcagagataaggtatgtaaacaaataataaaaaatacaagagagtaagataaatggtaacaggatagaaatggagtgccaagtgtttgagtaaagactgctgagaagatctggttgctgaagggccttaaaagtaaagggaatatcgtgaacaaaggtacaagattaggatgaagagtgagaagttggtgccagaagttaaaaccaccccagaatgaggggacattaaagaaattcaaaggtctaaagtggttaagtaataattcaaatggttctttttttttctgccctagtttatatgacttactgccaacagtacccatggctcagtgaggcttcatacttatagaggtggtagggtatgaatcagaatctccttagagtcctgagggtggagggcaaaggcatagtttgaaaatgcataccctcttcggtattctaatatctctcctgatggggaatcactgattgacattgtctcagaaatacattttctgtcctttaaaaattctgaaataatatcaaatttttctcccctcagaagcctacgccaaataagtgctgtaatcttagtacaactttgtagtacagtcagactcatttgttgatgtctgactggctgagtttttaaaacctattattcccccttccgccccatatctggacatgccagtaagaaagctcaaatgcttccacctttgtgcctggtggaagttcaaaccacctaagaatcctcactgcagccctacctccaagccactaggaaaagccaggctcctctactttccctgctcaagccatttctggacctgcttgagaactcgctgctctctgtaaaagcctcgtgtgagtgataaaccttttcatatctatttggtcctaatgtaacatcagtcctaacacctaaaccaagttttgggtaaggggttcaacctctcctctgtgggatgactaaacactttatgcaacaagcagagggtctaggagatgaccactaccactgcagggctctcctcttgctttagtttgctaactgactcttgctggctagaatttttttttttttttttttttttttgtcactgctggcaagctcatgctttgtgctgtgctgctttgtactgcgttcactgagccttaccaagcttctgttatagatgtgctcagctaagttggaatttttgataattggcatttaagaacaagaataaagtggcatttaagaacaagattaaagtggccctgggtcatgtgtcttggtcgagacttacctgtgtctctgaattgtgtttctggatcccagtgtcagctgtgactgtcacgaggctcagaggaatgactcttaccctgtgacttttggttgtttatctcaaccaggtgttgccctcattgtatggcgtactcaaaagaaacagtcataccctatgcaatatgcaggctggttggtagtcactcatggacgaagaccatgttgaatgctatggtgcacactcccaaaagcagatggtttactaggactttacaaaatgcctttcttcctacttctgcctatgccctatgccactatgccccctgaccaaaaaaaaaaaaaaaaaaaaaaaaaaattcctgatcctaagggttatagggaaaagcatccatgctatagccaaggagttctttcaaagccaacttaagcactgggtcctcaaaccctataaagcaactgttggcacgggagagaacctaatcctgattatatgtatttgcaactctggaggaagaatcttacacatatgagcaggatcgagaggaccttccctcctccccaacccctccccacaccaccaccaaatgatatacggtagccaccaaaaggaaaataaaataaacttggatactgggggaaagaaacaaaaaactaaaacagaggttcacaatttgacccaattggaaatccaaaattaaagaatttttgcaacaacaacaaaacaagataaaaggttactatttggcttttgtacctctacaacctaggttccgaattaacttttaacatttgctgaaatgcaccagttgtcaacccttcatagccttaatattgggcttcaaattatacctggaattcccctaaatttaaacaaagtacccctataatcttagggtagttaactgaggatattttaggacatgttaggaagacaaatagatatgcctcatcttaatcagaactattgccctgcctaaattcccccatagccatagcacccattaacttaaaatatcccatagtgggcatggatgctctaacccaatgagtaataaattaaaattgaattaagtctttggcacttacaaatcagcttgccaaaatgggacggcatggaccttcccctcctccgttagttaaaatagttaatatggcccaatttaaattaaaacagagtctttgaggtttgaaacccatataccagacctatttggagaagagtgactatccccactgcttcaccattaatggcccaatgtagcctgttcagaaacctagaaagaatgaatggcatctcacagtagattattgccatgttaatgctgaagttctatccaataaggctcccatatcaaatattatcaaaattactaactttaatcaacaactggtaaatacttttaattcatagatttggctaatattttagcagcgactcagccacaatttgccttcaccatcaaagggatgcagtatccttttactcagctactcatgggataacaacagccaggtcttcacacagcctgcagacaagatcttgaccacatttaactttcttcaggagcacagtaaacactgatcatactgatcacatcatcctccaagaaggttcatttggcacactcactgaggacacatatagtcataatcataaaagagctcacgaaaaagggatggaccactaccccacacaaattaccaagtccttccaccttggataaattcctgaaagctatttagctgagggccattctatccctgacacttgccagaaacagcattcgcaatttttttaaaagcccaatatgttttagtctattttgagttctggagacagcatatttctcatttacaaattttacttaaacccgtttatactattacttaagctcacttatgaattataatacaggcactgcaattagtgacccctgagagtcctttacttaaaggctttagcaacctcctcccatgattcctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtaaagggagtttctccactttatagatggtatcactaccattgtatgtgatggagcttgctggaaagttcctgatttttagcccataactgggacatccctgataatgaaacaggacccaagtcagcacaactggccaaactttatgcggtccttttagcactgaataccctgaccaacatctgcacagttctatagactgttgaaccactgccagtgatttgctcatctgctccagccaatagcagcaaaaacagttttctatccaaggttgcctctttgggttaaataactctgtgactctcttgcctcatatatatatacttatactcaaagtataagtcaaggtcatttctactcacaataaatccacaataaaaggcctcattaacactttaaccccttcagtagtctagaaattattgatagtgactaaggcattcatttcacatctcaaaatacataatattgggctcttgtacaaggcatttaatggaactttcacctcccttaccagcctcaggctgcaggcctcatagaaagccataatggtttattttacctaaacaagttcaagttcaattaaatgaaacatgccacatttcagtcatcagtcaaatatcagggatgaatcgtaataaagattctgactccatttttggtacttgactgctaacaactttcaaattcttctacttactccctcttcttcagcttcacatctgggaaaactgatagggaagcctaggtaggcctacctttggtgccagagggaagctcaatccatgcaagccccagataatatatgagaacctccccaaccttaccctacacccctcacctcccaatccaagccagtctcctttccctgctttctcaaaccatgtttggacctgtttggaagctccctctgctctccctagaaagcttcattatgtgagtgatacatcttttcatatcttcttggtgtgtgtgtgtggtatcatcagcctcaacatctgaagcaaatgttgggtgggggtacatcccactacttctgagtgacaacagatgtttagagttaaatattgaaagaaatttcatattacgataaatgacaatttcagaccaggtgcagtgagctcacgcctgtaatcacagcattttgggaggccaaggaggggggaatcacctgaggtcgggggtttgagaccagcctgaccaacatggagaaaccctgtctctactaaaaatacaaaattagcaaggcatggtggcgcatgcctgtaatcccagctactcggggaagtctgagggaggagaatcactcgagcccaggaggtggaggttgcggtgagctgagatcacaccattgcactccagcctgggcaacaagagtgaaactccgtctcaaaaaaaaaaaaaaaaaaaaaaaagaagagaaaaaagaaagaaaattttgtaagttctgagcaaccacatgaataaagccatgtgttttgtgaaatgacgtttaatatttaaacttaaaactagtaataaatctctaaatctctcagaccccaagatatgaaacttgtttgacacatttaatgattctgtaaaagtgtaagaaatgaagttaaatgaagaatgtcatggcctgaaaggatggaaaggcattagacatgcatattaccttgcctgatccaagactcagggactggatatagaagaatgaaacttccattaattgatacactggaagaaaggccacatacaaataggcaaatataccgtagaccctgcatagaaggctaattagctaaatgtaaggtgcaaatgctcaagcaacaaccctgaaagtgtgtattcctcctttctgctctggcgactatgcctatttattctcctcaatgaaatgggcatattaactccagcctatttaatatgtactacaactactcttcaatgccccataacattttacacaagtaaaagctgcctaaaaatgagcagcatagtcagcctctctgaatgaaataaaatgtctctaaataaaatgtcagaaataatacaaggtatggcagcaggaaagtagcttaagaaaacaaattgcaaaagggaacatttatttttcttctggacgataccatctttttctatgacttcaatcatgtatgcagctacataccaaactgtatttttcatgtcttaccttctttttgatcaccagattggtgtatacccagctgcccattttatattgccagttgtatataccttaggaatcttagactcagtatattcaaaactgaacttggctctaccatacctgctgctccttttttatttcacctaaggaactccagcagtcactcaggcccttaagtcagaaagcttggcaccatgtctaatcattttcctcacctttcaccttctactgtcccatcatgaagttctcatcattctagccacttaatatttttcacatacattaattttttttctgaatcctcatggctgctaaattttaagctattatttttctccttgaaacactactacaactccctaactgatcctcctaactctaatctagcatctcacatatacttcctcccatcccaagtcaagccctatcccacactagccagagtcaaattctaaaatgcaaatgctaatgataatatacaaaacctttaaatgacctttaagtgctcctagcaaaggtacaactttcttaacatggtctatacatcccagtgggatttgattcctgtccatctatctttctaggtttatcttaccaccacttccatcccctctagagctttgctccatccacaatttcttttttcttatctcagggacatttttgtacatgcttttcttgcatcttggaacatttaccttctccatacccacctgtgttggcctaaatcttaccttcttcaagtgttctggaatgcccttttggatccaccttaactgttttgagccaggtgttcatgccacactttatatttctccctctagcatttacatatttcatggtgatttttctcattaaatatctttttccaagactaaaatgagctctctgaaggcaaggcaatatttaatttactgctgcatccatagcatctagcacagtacctgaaacatagtaggcactataattgttgctgaataaaaccagaggtcagcttagctcatatgttgacatatgtgagcactctgggtcacaattagcatcagctggttatgccacctcctgcttctcctagtacctgcatccctgaatcattaagtctagctgcaatagaaagtggggtatggttgaaaggtgggaggagtggttccctctgatttgcttttccttagagaatcttctcaactgtaaaataattgaaagttgcgttcctttctagactcaacccgaactttgttttggtgcaatgtcaccattggaagagaaggctcaaaaatatacctttcattgtgtgttatatgaaatatatctcaataaagctgttacgaacgtaaaaatgtgaccttgagcaagtgagtttccacgttaggaaatggagataataaatgcccagcatacctcctggcatgtaatgaattctcagtacatgtcatgtggacttgggagtcagacagtcctgagatggaatcctgtctctgcctattagcagccatgtgacctttggacacatggccttttgaattgccactcaacacacttccttggatgggggaagaaagagagagtactaatcctgtttgagtcctaatattattaactaatggttctctttgggcaattatttttcttctccatggcactccatttccaccatctatatttgttaaattaaggatctttctagttgtaaacttcaatgattctggtgccccataccccggagacttattgaatcaagatctccaaaaggagccttctttctgggcatctgtggagtaggagggaacagcaaggaagaccctaaagacaaaggaccctaaagaggaaagcctggggcctagggctggtacatcagatgaagacaactaaggccagctcctacccaatgtatcaatggtgaagttgatctctaaggcccgtctcagagctggcactctgactcagagccaaggggttgctaggaaacaagggtctagagcctgctggtcagcatcatgcaggcttacatcctgccgatcaatctccctcttttttcgctcttcctgactaagtacttctaattgttgcagggagaagagaaatgccacacaaagagaactttgggagtgcccactttggctaagtaatagtaaaatgtaaatggtaagagaatcggagcatgaaaagacagaagaaagagaaggcatgagagaataccatttgccaactctgtgcctttgggttgtatatcttacccctcactcccaaatctcagtttacttccataaagataccaattttaggaagttgtagggattaaatgaaattgtgcatgtgaaatgcccagcatatctcctggcatgtagtgaattctcagtacatggcataaggacttggaagtcagacagccctaggatggaatcctggctctaccttttattagccatgtaaccttgagcagataagttttcacattaggaagatggaaataataatttggacctcacagggttgttatgaagacaatatgagatcatgtgattaactaactcataataggaactcaacacatgtaaatcattgttgccctttcctctgtcaccttctcttccaacacacatatacgcacatatatacattcttctagaacaatataagcttggtgttcagctgtgcaaacatgctcccatgtgccctactgctgagctccaggctgtgctatctgacattctcaccttctattcccacctccaggtttaggaaaagctcaaattcaaaagctgacagattagccagggagaaacagccatgacataggaagtctggcaggaagaagacatatatcttaggctgctgtagtcaggaccagaaaaggctgtatcattatgccttttgcttgagaaaactaacagtaataataatcattattggcttaattatgtctcatgataataatgaatgatgatcataatagcatttcctcagcatttgttatatgccaggtgcagcagtaatcactttacaaacatcaattcatttaaatctcataacaatactgcaagataagcataattatacccatgttaaagataagagaattgagtcccaggaacctaaaagacctgacctaagtcacacatctagagaatggaacagatgacacatagcttcttatgtatgttgccatttgttgaaacttacacctgtcgggaggagaatgcatcaatgactgacttgtgctgagttcctgctatgagccacgtaatcacatgatctcacatcatctgcataagaatcatgtgaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaagaatcatgtgagatctaaatgtttttccagctattcccctggtatctcccaaagtggccagttgttttcacttaatttaaggcattggagattcagtcttttctatttgtgacagttctcagctgtggacagaggcaatggaagtgtctctaactacttgggagactgaggcccagtgacattcaaaggtctaacaaagaagccaatagcattccctaggagcactgaggggatgcaggtactatattgctcctaactggtccaagagacttcgccattcctaaaggtgccaggccttcctacaaatctagctttgcattgttgtctccttgcgtggagtctccttcctccccaccttcccagttggcaaatgcctactcacccttaggttcctgtttagacatcttttcctccaggaagacttcccagtccaccctcagtaggttaggggcccatctctcagccttgttccctccactccccaccctccatacacatgcacactttatgctttcctctatcacagcatttatcaaattataaagcatttattaaaaaaatctgttcacctattagtctttcccatttgactgtgggatctttgagagcagggactgtgtctcacttgccttagcctccttagcacctcatattaggggctcaaggaactactgtggaatgatagagcggtgagaaaggataaaggaaagaaatgagaggcagacagggaagaacagggccccctggggtgtggtatctgaaaggactgtctgtgagcaaggctcctctcaggttggtaggttagacctgctgataatgaccaagggaaggcaaaaacttcaatgtatgtatctgtattccctccaggccattttgttctcattaaggggctgaaggcagagagatagcaaaagctccacattcatctccagggaaattccacattcttagtgccagactgctgagagaaaagggtcctatctaacaatcctgctccctcaggccctgcatctctgtctgggactgtgactgtgacaggggaatgagtatgattttgcacctgtttgaatcagagtaactagtttacaacagtatcaatctcttgtcacttcccctaggaagacggagagtggggatggtctccagtgctttaggtaatgatgcacacacatataccccaaataatataatgagcagtctgccaatcaaagactctgccatttataagtacatgggaggctttggcaacaggtagtctttgaatttgttctaagttttctggagagggaaggccaaaccatgtttctacctggttattaaatttctcccttcaccactgcaatttctaattgattgcataaagctgacctcatctttcccatctgtagaatgggaatggctaaccaagataagaatggaaaacaccttacacaagtcactatttcttactgtcacacccatgacagacattgctaagtaatcactgcattcttttccactgagcagagtcctggcccagaacctcaatgcagtattccaggcagttgattgcaatgggcacataaagaaaaactcaggcctgactatgtgattgctaatgcctcttcccactctgactttgtaaggtttgactttactttataatgcagccctgaagctaagattcagaagcagattatgctgggagatactggtggtaaagagaatattttcacccctgctcaagctgaaggtctaaattccaagtcttagctttcctaatttcttttacctgtggataagagaaacaacaggagagcaaatgtttacctttgggtttgataccaacatctaaagagttctctgaggctgctgtggtatgactgaaccaacaccaactccgtgattaatcagcctgggttcaaatccctgctttgccaaattccctggtgtgaatcctgacaagtcactttccccttctgagcctcagtttcctcaagcatgaaatgcagataacaatgcttgacttacagactttttgtgaggagtaaactggatgaaataatgtatgtgaaagtgctttgtgtgatgcactgcactgagcacatacagaggattattattcttggtatgcaccaataggaagaagactagggtgttccgttccagatggactcaatctaaaccggggaacaaatgcttttttttggtaatttcatcttgtggaaacggcagtctcatgggcctatttgtgtttaatgaaccacatcctgtatcgtctttttgcatggttctgaggagaaatacgttggctctgtcttctggcgtgctgtagactagtgagtgtcaagctcatatttaacctcctccagtctctctgccttctgcaagaaaacgcttccctagagctagattgatcctacaaataactgcacagaagctaaggcacaaagggagaggaaagggatagttagccaactctcaccaccatgctgggaccctaccatagacaaatgcagccaggctgggatttttcacctaggataaaattaaggagtttagattcagaggtgactgccctggggtcaagcagctaggaatcagaaaagccaggtttatctgagttcaaagtcagtgctttcaaattttcaacaaattgcttttaatacatcagtagtcttcatcctttctggagtcagagaaccctttgagactgcaagaaagctatggagactttcatcccaaataaaacacaaatgcagatgaacaacactttgcctataccactaaggcatttatgaccctcccaggctcactcaatctcactcactcatttatttcaataaacattattgaatgctatcaatatgccaggcactggctaggtattagccaagcaggcatggtccctgccctcacagagcttatagtgcagcaagagagaaagatgtaaactaataaatgtgaacttacaaacaggttatgtgtagcaaaggaacatcattctaagaaaataggaatgtagcaaaggatcctgacatagcctgaggcttcttgaaaggttttctgagaaagtgacatttgagttgggtgatatgaagtgatctcagcaaaaatgggaaaaaaaaatcagcagaaggccaagtgacaaaaggattgcagcttgttctaggacttgaaggaaggtcagtatgacaaaacggcagaaagcacggagacacacagggctgaagaggttggctgaggacagatcagaactgttagagccctgaggccatgggaaggaatttgcaaattatcctcacggcagtgacaaggcacctagaagttttaatccaaggaataacatgatgggatctctattttagaaacatcctataatggttaatttcatgcgttaacttggctgggttatcaaactatttggtcaaatagtattctggttatgtatgtgaggatgattttggagagattaacatttgaattggtagactgactaagcagattgtcctccttaatgtgagtggacttaaaccagtaagttgaaggccccaatagaaccaaaaggttgaccctcccacctgaatgtcttgagctaggacattggttttttcctgcctctggactccaatggaaacatcttcttttgttggatctcaagcctgccagccttcggactggaactatagcattggctctcccacttctcagggctttggattcacactggaattacaccatctgctctcctaggtctccagcttgctgactgcagatgttggaacttctcagcctcaataattatgttagacaatttattataataaatctatatcatctatatctatatttacatatctatacctgtatctgtacatatatatatatatatctgcctataagtctctcgctacatatccatcctgttggttctgtttctctggttttgttatcctggctaatacacatcctcagggctgccgtgtggttaggattcagggaggcagggtagatgcaggctgaccaggcaagagaacaaagctggaatccagacaagctatgatggtgacttggaatagggtggcaacagtgaggaagaaaaaagtgggcaaatttaagagttatttgagaattaaaattgacagaacttgaaatggtttggaaatgggtggctgaaatcagcagaagaccttctcagaaactaaggtacaaagggagagggaagggatagttagccaactcccaccaccacagacaaatgcagccaggctgagatttttcaccttggataaaattaaggagttaagattcagaggtgactgtcctgggatcaagcaatttgaagtcagtgctctcagatcttgagagagggtgttgagaaggattcctaggtttctggttctgcttctaaacagataatggtgcttctcactagaacactagaaaagtattaggttgtgtggagtggagtttgggcaggcaagagaactagaatgatagcaaatatcagaggaaagcttgatgttggaggtataaagtagaactcatcagtgtggggattacaacagagatcatgaccatagaaacaagtctagaaagaggggtccataagacaggctcctgtgaaacttcacttactaatgttgcagaagaggatgaacctgcagaggagacagagatgcaacagtccagaggggaagtagaaaatcatgaagatctagtatcaccgaaacaaacacagaaagtgcctcacacaggaagcagacaactttgtcaaagcctactgaaaggtcaagcaagatggaacccgaaaactgtccgcaggatattgaatcactgaggaagtaaaccaagaccttgcaggtctcagaccctaagaacaactccgttcatatcttgttgccatcttaaaagcaagttccctcgggaaactgaaggctctggagaattatccagctctcatcagccccttggccacatctgtcctcaaagaaaaggcgacagttgaataatcattcccttctcctcctccacccacaacccctgagatgccttttaaacagccaaaaactcctttaaaaagtagtctgggaatgtttcagctgacattcaaaagcacattgtaattcaaatggaagtgcagaaatgcaatcccttggacagtctaggaaaatgataatagagataagacaccttttaaaagtggcgacatgtatttatctgtggggacatttctataccatggactctcccaatctaaactcaggagcagtgcaaacttcacatagagaatgtccttccacaggggtcacctaggcagtacacttggaaaagacatgttaattgcatagcattctttcacttctagcctctctttatctcgccatttctctttgtggattttggtgtgcctttgtctatctctctttgtttttctgtctcctcctcccctcccctcttttctctctctctctctctctgcctttcttttcctctctttcttgctctagctctctgtccctccctctctctcacacacacacacagaatgaacaattctttcacatacacacatctgtcaccttccatagtcagtttctctataaaaaagaagcaattaaaaattcaaaaaacttattatatttctaattcctgcatctatcactatcctccctaagtagagaatgacaggggatgataaaagttacagattccttttgatatctccccagtccagttccacagctctttcccttcactggctccaagcctgtagctaaactcactgaggcccctcccaatcccaggacaatctacctctgcccttgatcctgggtcacaacgatgacaagggatgagagcaaattagcaagccccacccctgcccacacacatgtgtgccttcacgcacatacatacacacaaacatacacacctgggaacacagtaatcgaagtggatgtggcagccttgggtggagggcatgggttggatcaagataattaggccctcaactcagagctggatgggtccatccattgctctattttcttattccatctatacaatgactttgcattttgcatatggaaaaactgatcttaaagaatgaatcactttgctcaagatcacacatctgggaagaggtagagctgggatttgaattgagatccatctgattgtaaaacctgtgctttatctccaaatgagaaagtctttatccaaggtagccacaggaagggtgactttatacagtgaaccctcatcatgatataaagctcatgtatcatgatcacagctagggagaatgcgtgaatatcaagtcaaagggtgaaatggagccccagtgggaagaaggtagttttttcaaaatacagggatatcaagagcacagaagcatgtaatgaaagtattatgctagaggaagagactcagaagttcacacactgcttgggggaatggcacgggagcagaggtgatggctaaagaaacctgacaggctaaacagcttccatgctaatcatgtctggaacctagagcttccagggatgactttggctgctctagttgtttcctaaggcccagttcttcctgcattagattctaccttattgacctgttcggtgttccagtcccctacggactactggaaagctcagaattcccacctggtgatataaaactctgccttcctgcctggagatcttaccagtggttattggcatgcccagtgccccctctggaatcaacatcaaaaactaggtctgttattctagcttttatttttgccctattacagggaagaaaatacagaggatctagaccactatacttcctttctgtgtctagaatagacattaccaactgatcatctcaatgatcccaataacttacacacagtgttctagacaagccattccctagttgatcagaattggcacatgaaagctagagagcataatatgatagtgactgggtattccaaccagcctggaaatgttggcctcctccctcttcccagctgtctaccagtggatttttaaaagtctgtaac

SEQ ID NO: 582 - DNA, 129719 bp, Homo sapiens
aattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataa

SEQ ID NO: 583 - DNA, 133028 bp, Homo sapiens
agaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccaggttcaagcgattctcctgcctcagcctcccgagtaactgggattataggcacgtgccaccatgcccagctaatttttgtatttttaatggagatggagtttcaccatgttgttcaggctggtcttgaactcctgactttgtgatccgcccgcctcggcctcccaaagtgctgggattacaggcgtgagccaccatctctctcttttttttttttttttttttttttgagacagggtctcgctttgtcacccagggtggaatgcagtggtgtggtcatagctcactgcagtctcaacctcctgggctcatgtgatcctcccacttcagcctcctgtgtagctgggaccacaggcacagccaccatgcccagctcctcatatcatttttttgggcacacgtgcatgtttggttgtctgccttgtttcctccaatccctttcattgttttccacggttcaaaataaaatgaaatcttccactgtggtttcctgacttattttccccatgataggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtggactttctgtgtcatacaaagagaatcgagtggagaggttcccttcagcgccttcatgcctcctcctgcctgtgtttcctcgaggtccaggccatcatctcagccccatacatgctgggagcacagaggccacgggtccgataagtcccgagttggctgccttccctcactatgtagcccggggctctgtgctcatacatactttacccaggagctggcatgtgaggcccctgcagcctccacctgctccatagtcagaatatctgggcgaaggggaggtggtggcccattcgccattacactttggagcacaatctctcttctctgaggagagtggaaatgcttactcacttgcagtctgagctccttgagaaacccagcgacatgcagaggtgagccaggggcagtgaggccccagcctgctcgtctcataactcgtggtggggtagccaaaactcgtctcaggttagaccagacgggcaggaaccatcccccccggctgccaccttgcagaggtgaccctgtgggaactgccttccctgagaatggccagccaggatcagcaccatgaggggcccgtgaatgggctcctcagacccacatgcccaggggtctggggaggcaggtcccccttcaccacacttgagaaactgcttgttgctcaaggaagttaaaccccaaacaaatgcctgtcacaatgacagccacactggccaggagcccactgctaagctggcaggagcgcagcagctgagtgctccctcaggctccgggaggagaggttttcttcaaaaaaaaggaagtggtcgtggcctggcctgtctcatgggcctaagaatgtctttcgtggcctctgaggttaaccttgcctgttcagtaacgcagctgctgagaggaaaatgggagtcaggctgtgggtacccccatatctccctcagatcctctgccttgagggctagagaccccgggggccccaggaatgctgcctgcagacaggcaggtcccccccaggccctccacctctgctagatcattctgcccaccactgtcgagggagcctcagctctgggcccagcaggagtccaggccttggggaatgtgcaagtaaacaaaacaggacaactgctggcctttgggggtttgcatctcaagtaggggatggcggttagtgccccagaggcctgggcgtgtgatggggcaagcactgctggggctggaggctgaggggaggactctttccagaagaggtgtctcagccaaacctgcctgacaagaagaaagggcaggctgggcgccgcgggtcacacacataatgccagcacttcgggaggccagatggtgtctggatgccaagacctgtgctcgccaaggcctgatttcagataccgtcagatcattccacaacaatcctacagaggctgcaaagagacacttccaggcaacttgtctgggcagggccccttcaagacggcagctgggagtgacaccgaaagaacaggctccagtgatctctgctgcttgtacccattgtcagtcccccagggttgtcggtcaccacccagggcttcagagttccccagggatgcctcgggcgtgccaaggctgtcactcagagacccctcttgttggtatttctgctgccctccctgctgcgacataggtacagatttctccccttcgtccattttaccaaaatggatgcgcgttgggacaggtgagtcccggactccagcggcctggggcccacacctgcaagtaacctgggacagggtttcttttaatcaagttgactgagtggagaaatggcccaggggattttctgtcctatcagtgttagacggatgacacagtggtgaagagctgtcagaggtaaaggcggacactaaagtggtagggacaggttttatttatttttctgagacagagtctcactctgttgcccaggctggagtgcattggtgccatcttggctcactgcaacctccacctcctgggtttaagcagttctcctacctcagccttccgagtagctgggattacaagcatgcaccaccatgcctggctaatttttgtatttttagtagagacagggttttgccatgttgaccaggctggtcttgaactcccgatttcaagtgatctgcctgcttcaacctcccaaagtgctgggattataggcgtgagccaccgtgcccagcagggacaggttttaatcagtcataagccattgctttagagagcagggcccagcgggaactgagctccacttggatttgtgcggaggtgatgggaggggtggtggttgggaggggggctcaagagtcaggaaggggaaccagagagagcaggaaggagtgtggttggcgtgacacctgtctgggtttgctaactggcgcttagggttaggctcctgccctcccttggaggctgggggacagggtccatcttctagtgttgctggaacaaacagtaatttctttcagcagctttgggctttctcaggcaggtacgggcatcccacagatgtggtcttgagatgttggacaccatgtaacttaagtcttttcatgggagtatgggggtgtggacttaagcatttgtgctgaaagtctgcagttttaatatgccaagtttgaggtctagtggagatgggagttcagaggaaggctggcgagagcgtgctcaaggagagaatttttgtcaggactgtggctctagattcaaatggcccaaattcaaatgggtttaaatcctgactctgtgacagagtagctgggcaacctttggaaatgttccttcatcttagagacttagatctctcgttttatttatttatttatttaaattttttttaagagacagaggtctcaccatgttggccaggctggtctcaaactcctgagctcaagcaatcctcctacctcagcatcccaaagtgctgggattataagcatgcgccaccacacccggccagatttctcatttgaaaaatgagtagaccagtccttgcttcccagaatcacctgaggattaaatgggatgatgtgtggcttaccataagccacagcacacaccagctgttcgtgtgtggctggagtcaggagcgggacccgctaaagaggaggcggctgtgctcacattggagtgcaagaatgtggggcctcatctgggctgaggactagcctggaccacataagatgccatgcttctcacactcaactagcaaaggaatgcccctgcgatcaggttaaaatgcagagcgtggtgcggtgggcctgccttcctaacacacttgcaggtcatgctccttgttttgggacccactttgagaagcgagggtgagaagggcttgacttccctaacctgatccccaggggaggcagaatgagcagacaccgcctggctagaatcataagagctactgggtatttagtacataccaggtgccaagaactatctgtatattattattattattgttttttgagacagagtctcactctgttgtgcaggctggagtgcagtggtacgatctcagctcactgcagcctctgcctcccgggttcaagtgattttccagtctcagcttcctgagtagctgggactacaggcacgcaccaccacacctggctaatttttgtaattttagtagagacggtttcaccatgttggccaggcttgtcttgaactcctgacaggtgattgacccacctcagcctcctaaagtgctgggattacaggcatggccactgcgcctggccagttattttgaaccctataacaattggcagatccttttattctgcccctgctagagatgaggagacagaggttcaaaggaattgtgcaacttgcttaagatcacacagcttgtcagtgaattcaaacctaaattcagaagatcccagagctctttctactccatggcatggatcgttaagatcacctctgtgaggtactggcctcctcacctaggaaaggaggaagatgatgaggctcatgtcaccaaggagagcgtgctgtgccctcaagaagtgcatgagcttctgatgcttccagaataatctccgggatgcccccccgactgcctcttagggggtcaggctccatgatgggggtgtctgccctgtggccctggctgcctgtggagtgtcaagccagctgtgtgtccgagagagagagagattgtgtgtgtgtgtgtgtgtgtgtgtgtgtatgtgtgtgtgtgtacatatgcaaacaaggagggcagagctggggctcagggctgaccatatttttcctcctacctgtgagggcagatgtcttactgtgttttgttttgttttgcttttgagacggagttttgctcttgttgcccaggctggagtgcaatggcattatctcagctcaccgcaacctccgcctctcgggttaaagcgattctccttcctcagcctcccaagtagctgagattacaggcatgcaccactacacctggctaattttgtatttttagtagagatggggtttctccatgttggtcaggctggtctagaactcccaacttcagatgatccgcccgcctcggcctcaaagtgttggattataggctgagccactgcccccagccagatgtcttcctgttaaaatggggctttaaattcctcacctaacatcattgtttgcaacaacagcaacaaagagcttccatagacagagtcagtgtcccagaacggggactaaacaaccaaacatctagaatctcaccagtcagtgaccctgaaggagacctcagtcacaacctttgttggagagcaagtggaactagggttttttaaagcctgaaagcacatcagttgtgccctaacaatgaaaggtttcagagtagttgaaagctaggaatttgaatatcttagaggaagttaagtggcttgaggtgcttccaccgaaggtctcagcaccatgagaatgcctgtgcttctgccggccccattcctgccagtgagcccacagacaaggggcgatgaagaaccaggaaacagatggaaagaaacgtggaagagaggaaagcctcagactgtcagggtgaaatctaggttgagagttaagttttagttcattctttggagagactgagccacaaggagccataattacaatagcgtttcagcacatccaggtgatcttggtctgcagtatttggttgaggactgtgtgaaagcagctgaggccaaatgtggtggctcacacctgtaatctcagcattttgggaggctgacttgggtggatcacttgaggccaggagtttgagaccagcctggctaatatggtgaaaccctgtctccactaaaaatacaaacattaaccaggcatggtagtgcatgcctgtaatcccagctacttgggaagcttgaggcaggagaatcgcttgaacccaggaggcagaggttgcagtgaactgagatggtaccactgcactgcagcttgggcaacagagagagactccgtctcaaaaaaaaaaaaaaaaaaaaaaaaagcagctaaggaaggctactatggtcacaaaagacttcccagaagatgggacttgggctggatcttgatagggaagatttccataaggagagagggcaggacatgggtggaacaggtgcaccaacagtagggcaccagggatgagagagctgctggttaggattatggtgagcaccacagaccacagacaaaccagaataaacgaacctgtggaccagcgtgtcctgcactgagacacacaccacgcacaccaacagggacgaagcacgttgcccacattgtatcgatgtatgcgaatgtggataagtcagctcattttctccttcccctccccacaaccaagtttactgctgctcctggctcccccatcctggggaatagcacatggtaagaacctcagcacccactccactcctctcgccctcatctccacacagctacctgtcaattccaccttcacactctttctgccaactgagccctcctcatctctctgcctctggcctgcctccccactacaactgagtttccatgcagttctcagaggaatccctcgaaggcacatgtgcaacctcatcacttccaggctgaaagatcttggttaagagaaatattagtacaagctattaagacttaggaggctgccgggcatggtggcacatgcctgtagtctcagcattttgggaggccaaggtgggctgactgcttgagcccaggagttcaagaccagcatgggcaacataaagagaccctatctctacaaaaaaaaaaaaaaaaaattagctggtgccttagtccgttttcatgctgctgataaagacatacctgagactgggcaatttacaaaagaggtttaggccaggtgcggtggctcatgcctgtaatcccagcactttgggaggccaaggcaggtggatcacctgaggtcaggagttcgagactagcctggccaacatgttgaaaccccatctctactaaaaaatacaaaaattagccagtcgtggtggcacgtctgtaatcctagctacttggaaggctgaggaaggagaatcgcttgaatctgggaggcggagtttgcagtgagccaagatagcaccactgcactgcagcctgagtgacagagctagactgtgtctcaaaaaaaaaaaaaaagaaaagaagtttaatggacttatagttccacatagctggggaggcctcacaatcacggcagaaggcaaggaggagcaagtcacgtcttacataaatggccgcaggcagaaaaagagcttgtgcagggaaactcccgtttttaaaaccatcagatctcgtgagactcattcactatcaaaagaacagtgcagtaaagacctgcccccataattcagtcacctcccaccaggttcttcccataacatgtgggaattgtgggagttacaattctagatgagatttgggtagggacgcagtgaaaccatatcagtcaggcatggtggcatgcacctgtaatcacaactactcaggaggctgaggtgggaggatcaattgagcctgggaggtcgaggctgcagcgagttgtgattgtgctactgcactccagcctgggtgacagcgagaccctggtcttggggaaaaaaaacaagaagacttagaaagctacagtgatgaaaacagtgtcatactggcacacgcatacagagatcaatgacacagaatatacagtagttcagaaatagctacttacagttacttagtagtaaaaagatgactggcaggatgtatttgtgccatatatgatagacaaaatgttaattgcctggatacatataaagcacctacaaatcaatttcagaaagaccaacaatccaatagaaaagtgagccagagacatgagcagctagttcatagcagaggaaacatgcatgacttcatctaggcagagatgctcaagctcactcgtaaaagagaagcaaattaatgtggtagtgaaatgccactttttcgtctctcagattagcaaagctaaaaaaaaaatcctgaaacttctactggtgagggtgtaaggaaactcagacatgacaggtagtggggcataaattaaacttctttggagggtaatatatctgtatttaaattgtaaatattctttgttccatttctactaatttctttcttttcttttctttcttttttttttctttttttttttcttttttttttttttttgagacgtagtctcactctatcacccaggctggagttcagtggcacgatctcagctcttggctcactgcaacctctgtctcccagattcaagcaatctcctgcctcaccttctggagtagctgggattacaggcactgcgaccattcctggctaattgtgtgtgtgtgtgtgtgtgtgtgtgtgtgtgtgtgtgtgtgtgtgtgtgtgtgtttagtagagatggggtttcaccatgttggccaggctggtctcgaactcctcacctcaagtgatctacccgcctcagcttcccccccagagtgctgagattacaggcacgagtcatggtgccagcctcatttctattaatttcttaagcaaatcaagagcatacattgtggcattgtttgtagtggcaaaagattggaaacaacctaaatgtccatcataggaaattcatgaaataaaactacctcatgtatccagaggaataccatgaaactgttgaagagaatggggacatagtccttgtgtgctgtgacaaaacgatctccacacacagtattaagggaaaaaaagtacctggcacggtggctcatgcctgtaatcccagaactttgggaggccgaggtgggcggatcacctaaggtcaggagttcgagaccagcttgaccaatatgatgaaaccccatctctactaaaaatacaaaaattaaccaagtgtggtggcatgcgcctgtaatcccagccacttgggaggctgagacaggagaatcgctagaacctgggaggtggaagttgcagtgagcccacatggtgccagcctgggcaacaagagtgaaaccccatctaaaaaaaaaaagcaaggcgccattgggaaggggaagtggggcctgcatggctgaattcagagaaggaagggagtcttggttatcagattatctctgcagctgatctccaaacctatttcccttcttcctggcacaggggccactcatttcccagactcttttgcatggaggcatggttgtgtgattgaaatccagccaggcgagcaggctcagcccacagaaacctcccatgggccacccccatgccttttcttcctctggtttgtgtggaatggtgctgagcccccagggcgactttggtggaatctggtgttgaaatcagagtcccaccgccgggcgcggtggctcacgcctgtaatcccagcactttgggaggccgaggcaggcggatcatgaggtgaggagatcgagaccatcctggctaacacggtgaaaccccgtctctactgaaaatacaaaaaattagccgggcgtggtggcaggcgcctgtggtcccagctactccggaggcggaggcaggagactggtgtgaacccgggaggcagagcttgcagtgagccgagatcgtgccactgcactccagcctaggcgacacagtgagactccgtctcaaaaaaaaaaaaaaaaaaaagaataagcaaatcatgcaaatcatcctgttctaaactctgaaccgctgcttccaagaccgtccctgcccttgccctggccgcctctctccttgttaactgggctccattcattctttccatttctctaacacgtgccaggtggtctcatctcctggcctttgcccttgctgttccctgtcatcattcaggtctcacttgtcatttcctgaccatggtacttataaaagcagtgccgtctgccccatccatgtcacctcgttcatctccttcacctccgaaatgatctcgcttttgggtttacggccggtctcttcacctggagcatcagccgggaaggtcagggtcgccctggctcgggcctgttcacattggggtcaaaggcacacattgggggctcaaccaaggcgagctgcgttcgcggggccgggtctttccgcacaggcggagggcggtggcgggcgcggaggcgtcgcgcgagccagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcactttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccattggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatataagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttactgggtaactctttgtccatctcaataaccaaaggaaggtgggcatggtggctcacgcctgtaatcccagcactttgggaagccgaggcgggtggatcactcgaggtcaggagtttgagaccagcctggccaacgtagtgaaaccctgtctctcactaaaaatacacaaattaggcagtcatggtggctggcacctgtaatcccagctacttgggaggctgaggcaggaaaattggttgaacctgggaggtggaggttgcagtgagtggagatcatgccactgcactccagcctgggagtcagagcgagactccatctcaaaaaaagtaaataaatgaaatagcctaaggaaatgctggcaggcagtaatgatatggcacactggatatgatttctgcccctcctctgctgtgggtaaacagcttctgtttcatgcatttacttttttattttaattacaccaataagaatgtgcttgaatgtttcatgcatttaatttgtttcatgcatttaacttctggcctgtttacctgtagcaggctctgagatgtgctctagagacagaacctaaacatgatgcccaagagaggggagagatactgaatgtccaatgttctcaaattttttttttttttttttttgagacagggtcttgctctgccatccaggctggagtgcagtggcacgatcatagctcactgctgcctcgacctcctgggctcaaatgatcctcctgcttcagcttcctgggctaatgtttgtattttttgtggagatgggactttgttatgttgcccaggctgttttcaaactcctggactcaagtgatcctcccgccttagcctcctaaggtgctgggattacaggtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatacaaaaaaaaaaaaaaaaactagccgggcatggtggctcatgcctgtaatcccagctactcaggaggctgaggcaggagaattgcttgaacctgggaggcagaggttgcagtgagccaagattgctccattgtactccagcctgggcaacaagagagaaactccgtctcaaaatataaataaataagaaaaagaagaaatggaagctgggttcaagagggcaatcagcagtctctaccatcatgtgaaacaccactctgtgatttgagtcttgacaatgtattttctttttttttttcttcttttttttttgagactgagtctcggtctgtcgcccaggctggagtgcagtgacgtgatcttggctcactgcaacctctgcctcctgggttggagcaattctcctgcctcagcctcctgagtagctgggattacaggtgtgcgccaccatgcctggctaatttttgtatttttagtagagacggggttttgccatgttggccaggctggtgttgaaggcctgacctcaggtaatccacccacctctgcctcccagagtactgggattacaagtgtgagccaccgtgcccggccaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggcagggtaaagagtgtgagtcatctccaatgacaggtaaggtcacgtgggtcacgtgtccactggacagggggcccttccctgcctggcagccaaggcagagatagacagggagagagagagacagcttacgccattatttctgcgtatcagagacttttagtactttcactaattttgctactgttatctaaaaggcagagccaggtgtacaggatggaacatgaaggcagactaggagcgtgaccactgaagcacagcaccacagggagacggttaggcctccggataactaatgattaatgatattcatatataatcatgtctgtgatctagatctagtataactcttgttgttttatatattttattatactggaacagctcgtgccctcggtctcttgcctcagcacctggatggcttgccgcccacagccaacaatgtgttttcaatatgctccccaaactacagcaaactcctcttaactcgggatttagggtgatgccctacttatgcctaactttatcaccagcttaaccctcatctcattatataggatgatattacttctaggaagattttctatgtatggagggtgcatcatttaagagtattttaggccaggcactgtggctcatgcctgtaatcccagcattttgggaagctgaggtgggtgatttgcttcagcccacgagttcaagatcagcctggccaatatggtgaaaccccatctctacaaaaaaatacaaaaattagctgagcgtggtgatgtgtgcctgtggtcccagttactctggaggctgatgtgggaggatcacttgagcccaggaggtcaaggctgcagtgagctgtgattgcaccacttcactccagcccagagtgagaccccatctctgaaaaaaacacaaaaaacaagaaaagaatactgcaaagaaccttggtaggggtgaattggaaaaagtagagaaatgtaatatttctttcctgctgtactcactgtaactgtgagaggatcggctcttttaaccaacagataagaaaggaaatattagctatgaagaaatgtctatcaagttgattttgacaacctagacacattaatctccttgcacttttagtgacaggaacccattagaaccttaagcagctgtctgaagtaaaaacaaagctctcaggtgatgaaccacctaatctccctgggtattcggatgtgggtcagtcacaggagtattaggtgtaaagccgctgcttctgggtagagcctccacttgtggctgcacagagggcacagagagcttttccttcagcccggagaagcttcctaagtgtgggcgccaccttgtgggacatacattgaactacgacgctatttctccaagaattaacaggacagcccctcccaccggtgtccttccaacgatgttgcatacaatttggctgtacatttggcaggcagtgtaatgagggaatcaaagaccaggatcacatactggaaagaattgaaaacagagactcccaacaaaaacttgtacacggacgttcacagcagcactattcacgacagctcagagatggaatcaacccaaatatcagtcaatagatgaatggacagacaaaatgtgacatatccatgcagtggaatattatttagccataaaaaggaaggaagtgctgatgcatgttgcgatgtggatgaaccttgaaaacatgatgctgagtgaaagaagccagacacaaaaggagaaggactgtatgatttcacttataggaaatatccagaacaggcaaatctatatagagagaaggtcgattgctgggggccctgggaagggaccaagggggagtgacttctaatggtggggtgcccttttggggtgatgaaaatgttttggaaccagatacaggtggtggttgtacaacattgtgaatttactaaatgcaaccaaattgctcacttaaaaacaacaaattcaggccaggtgcagtggctcacacccgtaatcccagcactttgggaggccgaggtgggcggatcacatgaggtcaagagttcgagactagcctggccaacatggtgaaatcccatctcggccgggcgcggtggctcacgcctgtaatcccagcactttgggaggctgaggcgggtggatcacgaggtcaggagatcgagaccatcctggctaacacggtgaaaccccgtctctactaaaaatacaaaaaattagccaggcgtggtggtgggcgcctgtagtcccagctgatcgggaggctaaggcaggagaatggtgtgaacccaggaggcggagcttgcagtgagccgagatcgcgccactgcactctatcctgggtgacagagtgagactctgtctccaaaaaaaaaaaaagaaaccccatctctacccaaaatacaaaaattagctgggcatggtggctggcacctgtaatcccagctactcaggaggctgaggcaggagaattggttgaacctgggaggcagaggttgcagtgagctaagatcgcaccactgcactccagcctgggtgacagaacgagactgtctcaaaaaaaaaaaaaaaaaaaagtggccaggtggtgccatggctcatgcctgtaatctcagcattttgggatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcaaaaggaaatagatgcagatggtatagaaagtttcagtgaaatgtaaatctgatgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgcagcctctacctcctaggctcaggtgattcttctgcctcagcctcccaaatagctggtactacaagcatgtgccaccacagtcagctaattatttttggagagtcagggtttcactatgtagctcaggctggtcttcagctcctggcttgaagtgatcctcctgccttggcacatagaaggggttacaatatacatatattagagtgagagcatagatgtgatgcctggcgatatggcttacttatgagacagcacctgacctacagccatctatgactcctactgtatcttccatgccaggagtaagggtgaggatacctggcaataataaaaataataacctgagagtctaatggcttattttttgtagagatggggtctcactgtgttgtttaggctggtcttgaacttctgggctcaagtgatcctcccacctcagcctcctgagtagctgggattataggcgtgcactaccatgcatatatatatatatttttttttttttttgagagagagagagagagatggagtcttgctatgttgctcaggctggtctcgaactcctggcctcaagtcatcctgctggcttggcctctcaagtgctaggattacaggcatgagacactgggcacagccctaatagcttatttttaaagctatatcaaaatgtcatgcacctgaacatttgaagtaacctctctgatagtacggatatttatcccctcaaaatctcatgttaaaatgtaatcttcagtgttggaggtggggcaaggtgtgaggtgttaggatcatgggggtggatccctcatgaatggcttggtgtcctcccccatggtaatgagttcactcaagagctggttgtttaaaaggtgacgtggacctaatccctgttggactgaacaaaaggggacgaacacagcaataaagataaagaccaaagagtatatttggaagaaggggtcagggggctccttgcttctagtgaaaaagggccctgagctttagtgccctttgtatttattgggtaaaggagatagggagaagggggggtggttgtcggtcagcagcttgattcacagcaggctcacaagattgcattctttgaacagtaggctctagatgtctcagtagataacctcaaagagcatggcgccagggagtgattgccctcagcgaaccttctggcggctgaagcagaagtgagtttgcccacattctgcatttatgataaacagtttgctgtttgatcatatagcctcagtggaatgctgagttggtcacaacccatgggcattcagctctctacatttccccctttctgtttatgaattaattgaaagaatgtaaggccaggctgggcagctctcattttctgattggcagtccatccaattttacagactatgaacagaagacagagacaaaacaacattattccaaggactacatataagatgttaatgtggtgctttagacaggtccaagggttgaggctctccaggccttgctggaatttggtctagtcttctaaagaaggctgaaactcttgagtttgtttatttaaatcaagaattttgttttgtaattcaccgatatcaaaggtgatgttggatgtgcaagctccctgcaaatgggctttcacaaggtcccatggatactcactttggttatattctaagttggttacacaaatatgagtgtgattaaaatgatggtgcaattgctgttgcaattgcaagctttgtacttgttctcctaactgtagagccgtggatttcaacaatgccacttcagtttgtaactcagtgttaattttattctgaagtggccatgcttggttggctatacgcatccagttttccatgtactgagttgtttgaatagaactatgcaaagctacagaggacatcacaacggaagttattaatgtgaccaaggaaacaatagcaaaaattatcatgcctaaggctctatgggcacaatgagtaagttgagttagaagatgtttcatgaagtgcaaagcaggtgtggtagcccaaggctgggacagattaacaggaatccatagcccagggatgcgacccaaaattatcaaagtagagacattatgtgtttgcaatgtgctatgattaatgcagtgacataactggcaagatttacaggtcaattggatattgtttacctggagctggtccttcttagttgccaaaaaagacataaggattaaaaagacaaaccataaattgagtggtgatattctttacaaatgtaacattaagactgtgttgcttactattgctatcactggatagtatcccgccattcataaatgggagtgctgccttccataacatctcttggattggtcctttcctccctagataatgccactgaggaagaggcgggctaaagcctgctccatgtcaagcaatctgggtggcagactgggattagatcccggtgtggtataaagaagaagcattaaaatcttgccaccaatgccagcgaagtttgtgccatgatttctgattttcatgttttccatatagttgacctttaggtccccaatccacaatgtctccagttaacatagattgttttctagccagtgggtcaagacattgggtccatgtcttggggggtagtaactatcgaagggaatccattccatatagtcagcacgattagggtgattgggccgggaatggttggttagcacacctgttacattaatagaaccaagacttaataggcacatgacttttccataatgactcaaccattcttgagcttgaattataagacagctacagttaagcgatgtctttgtagtgatacacaaggggagtccttctagtggggtggtataattaatgacattgttctgagagtctaactgttctattttaaggggagttaggggtcctggagcccatacttgctgatcacgataaatctcaggaggagtgtcactccaaagcataggttgtactactaggggattgggaacatatgcccaaaatgtttttgcctctgcacagggaaaacataccacacaggacattatggctaacatggccaagaacatggaatcagggtgttttgcctggctctgatgctccagtagtttcccagcttcctgagtggtattcttgagttgcccccaggttatgggggttgatgtcgtcatgactccggtcggccttctctccatctttgcactctggctcagctggctcatggctcataccagagggaccaggcccatagttggccaccctgggttcctctagtctcccgttccatggtcacatgcaccttgagggcacccacacggcttgtccatctcccataaaaacacaagcataccctcatccccacgtcagtaaatccaacagacctttccattgtcttttttccgggggatttcaataacactttcggataaactttcctcttttcctctaacacttgccaatgtctttctgctggagtcttaccatctgtaccaggagtcaaaaaaatttaaagaaaataaggctaagtgtagttttgtttgaggtgtaactggtctcctatccctcttttctgtttttccctttttttttttttttttttttttttttttttgagacagagtcttgctctgtcaccaggctggagtgcaatggcacgatcttggctcactgcaacctccacctcctgggttcaagtgattttcctgcctcagcctcccaagtagctgggactataggtgcgcgtcaccacgcccagctaatttttgtgtttttagtagagacggggtttcaccatgttggctagatggtctcgatctcttgacttcatgatctgcccacctcggcctcccaaaatgctgggattacaggcatgagccaccgcacctggcccctttctgttttttcaacacgtgttgtaatgtttgatgtgccaactctataattccttgtcctctaggattataataattccttttttatgggttatagctcaaagctgtaagaattttgaaaagcatgactagtataagctggtccattgtcaggttttaattgtttagttatccccatatgagcaaatgatgacaaacaatgttgccgtacatgaccagctgtctcacctgtttggcatgtagcatgcagcatatgagaataagtgtctataattagtgaacatagctaagtttactaaaggctgctacatgtgtaacatccatttgccagatttcatttggagccaaacctcatgggttacaaccttctacaggtgtggctccagggacatgctggcaagtaggacaggcttgtattatagccctagcttggctgcgagagaaatggaacatgcgagtagggcagaagtactttggtgcagaggcttgagcttgctgaaacacagaactaatcagtttatctgctctatcattacctagagatagtggtccaggaagttgtgtgtgagagcgaatatgagaaatatgaaaaggagatgaaggagagccaatagttgtttgaagtcttagaaacaaattaagcagttctgggtctagtgtatttttaattgtagcagtttctatgcaactggctacatttacaacataagttgaattacagacaatgttgataggatctgcagctgtcagctgtaaaacctgaatgactgcaattaagtctgagcgctgagctgaaaccccagaggtcattattgtttgagtatgtttaggtccataaatagctgcatgagctttagaagagccatcagtaaaataagtctggccacctgaaataggcttgtgatgagtaatcacaggaagaatgaaagaatggactttataaaactgcaaaactttgtctgagggatagtggttgtctatggcacccacaaagtctgcaaaagtgatttgccaggcagttgacatttcccaagctgtggactgttgctgagagtctaaaggaacaataattttatctggatcatatcccataggcatctttgacctatgcctgcccatagtcacaatttgtgtaattaaagaaagatagacttgcaaagttttgactgattaggtagaaagagccattctattacggttacagatttgtctaagcattggcctaaaagtcctgttggagagtgagggataggaagaacaaacaaaagcaaaggtttttgtggctgtagccatgaggcatgtcattgctgtagcatctgctctacaagttgtaactccacttctgcctctttggtcaattgctgtggggaatttaaggaagaatctccttgcagggtttgataaagatgtgtaagttgataagttgcaatacctagcattggtcacagccaatttatatctcctaataattattgaaaatcatttaaagtctgtaacctgcctttatggagaactactttctgaggccgtacactattggggaacctgccccgatattcatgtaggttcttttctatttttcctaagcattggccagcttgagaaataaagggacagagtacaaaagagagaaattttaaagctgggcatccgggggagacatcacatgtcggtaggttccgtgatgccccacaagccgcagaaaccagcaagtttttattagggagtttcaaaaggggagggagtgtgcgaataggtgtgggtgacagacatcaagtacttaacagggtaatagaatatcacaaggtgagtggaggcagggtgagatcacatgaccacaggaccaaggcgaaattaaaattgctaatgaagtttcgggcaccattgtcattgataacatcttatcaggagacagggttttgagatcaaccttctgaccaaaatttattaggcgggaatttcctcttcctaagaagcctgggagcactatgggagactggaatctatttcatctctgcagcctcaaccataagagacaggtgcacctgggggggctgtttataagcctatacctccaggtgcgtattctctttctcagggatgttccatgctgagaaaaagaattcagtgatatttctcccatttgcttttgaaagaagagaaatatggctctgttctgcccagctcaccagcggtcagagtttaagattatctctcttgttccctgaacaattgctgttatcctgttcttttttcaaggtgcccacatttcatattgctcaaacacacatgctgtacaatttgtgcagttaatgcaattatcacatggtcctgaagtgacatacatcctcctcagtggacaggattaagagattaaagtaaagacaggcataggaaagcacaaaggtattgactggggaagtgataagtgtccatgaaatctttacaacttatgtttagagattgcagtaaagacaggcataagaaattacaaaagtattaatttggggaactaataaatgtccataaaatcttcacaatccacattcttctgccatggcttcagccagtccctctgtttggggtccctgacttcctgcaacagtacactcccctccataacaatagttcctaagtattagtatggggaagttgtttgcactttctctggagcaattttgagattccatttaattaaagcctgttttgtttctctgaataactgatgtaaaatttgatctgtaggagcggccaaaagaatatcatccataaaatgaatgatatacacagtgggaaacatatttcaaggctcctttaatgctcttcccacaaaatgctgacataatgtaggactgttaagcatgccttgaggtaaaactttccattgatagtgagaaacaggttctctatgattaatagaagacacagagaaggcaaattgaggcttatccttctcgtgttatggtatagtaaagaaacaatccttaagatctattcctacaagaggcctgtctcttggaatggctgctggggaaggtaaaccttgctgtaaggcacccattggtttaatttgcgcattaataactctcaaatcatgcagtagtcaccatcttccagacttttttggaataacaaataccggtgaattccaggggctgacttctctatatgtcctgcattcaattgttcttttaccaacagatgaagttgatctagcttctcctgtgttaggggccattgatccacccacataggtttgtcacaaagccattctaatggtaaggcagtgggtcgaggagaaatatcaatgatccccatcagaaatcctgacatccttgcccttttctgtttctccagttatagatatcgggttagggtttccttgtaggaatttccctaaaccttttccactctgatatcccatgtccttcaacattttaaatcctgggttatgaaagttttcatttgtaagtctcatatcccatgctgtaagtaattcttgaccccataaattgatagctatatttgcatcataaggctggaaagtacatgattgtccatccggaccaagacaaggtaaaatctcagcactctgttgaacacttttagctgctcctactcccactagggatgtggaggttagtctgagaggccatgctgggggccagtccttactggatattactgacacatcagctcctgtgtccataagcccatacaatttctttcctttactttgtactacacaggtgggtctattataagctataggttgtgaacatagatttctcatgtagttgtgctcccaaaccctttatttcctcgtttctccttttatggagaagggtgtaatttgcagggaataagcaataattgagcaatatattcttccggttcaaaaacccaaagatcttgtgacattaaaactacttgaatttctccttcataatcagagtcagctactcctgggactacagtaatgccttgcaagttaaggcagcttttgcctaaaattagtctatgtatcctgctggtaaaggtccccaaatgccaatgggaactttgataggtttgtctccaccaattaatgtaattctttctctgactggaagatctaatcctgcacttcctggtgttcctggggtgagggaatcaatgttcctcctgggacccacccctgaagtggggttgtggtctgaactgggaatgccctcattgtttgaggggcccgggtccaggcccccttctcgtttcctgacaggtggttgcagttttgatgaaattttgagcggcattgaatagcccagtgatttcctttgttacagtgaggacagagtcctggcgtttttttccgctgggccaggggggtggagggcaccacattataaggtcctttctgccctgagatcaggcagcattcctttttaaaatgtccagtttttccacaattataacattttcccactttagggtttgaccgttggctccttttagatttgtcaactactaaattagccattgcttgagctaaaattgcagagcaatgaagctcagtttctacatcctgacaagttctgagaaaatttcccaagttttgtacacctcacaggtgccagtgcacgtttacaatctgcgtttgcattctcaaaagctaaagttaaggttagcatttctgtggcagcggtatgaggaatttgatgcttcactgcctcttgtaatcttgcaagaaattgcacatagggttcctgtgacccttgcatgagatgtaaaaaggattgtactgggactctctcttctggaattgtggcccaggcgtgtttagcagcctgtgcacactgctgataagcaggatctgggagtgccatttgacattccaggtctgaataaagggccattacctaacagcataccctctgtaatgtctccgtgtccagaagcatgattctgtctagcctggtctgcacacatttcttgccaatttaaattccaagtcaggtatgcagtagcagacaaacaagtgcaagccaaatgttttacatcaaagggtagaaggcgcatagcaccaaatacagattctagcaatcctaaggtgaatgggctctgtatcccattattaattacacttaatttttcattccttcaacaacgtaaactctagtggggtgtgttcatgaataaactgctgtggattgtttggatcaggccttatggaaataggaaaagtgcaggcagcagagcataaaattctttgtattgaggtctctatttcggctactgaaggaggcggtacagatgtttctgcaactggagggggcggtataggccaatttttatcctccctctcctgttttttattttcaattggtgctgtgggtgggacaacagattctttcagatttttagactcagaacatgactcctgctgtccagcagaataaaaaggatataatggcagaaggacagtatgaactaaactcctagtggagaaagcagaagaatcaactttaagacctttttgatgagcctgttttaatccttctcctgctctgtgccaattttctacatcaggagtgcctgcctgtggaaaccatgggttatgcgtaataacctcctgcagcatcttagttaatgtctgagaattaacctgagcaccagattgtttcaacaaaactttaagcaactgcacgttttttttttcaacagacaaattctgccccatgttacctgattcagaaaaattcccattcccagtacttctttttttttttttttttttttgagatggtgtctcgctctgtcacccaggctggagtgcagtggtgcgatctcggctcactgcaagctccacctcccaggttcacaccattctcctgcctcagcctcccgagtagctgggactacaggcgcccgccaccacgcccagctatttttttgtattttttagtaaagacggggtttcaccgtgttagccaggatggtctcgatctcctgacctcgtgatctgcccacctcggcctcccaaagtgctgggacccagtacttctttaagagagcactgaccttatattgctcccagtacctcgttagggcactgaccttatatctgctgccagtggactcatcccagtgtccccattcgtcttgtcaatttcagcttctctgcttcagcagaccttcttcgttcatgtcctcagagtccctgttctggggtgccactttgatgcgtgaatggaccttggtggactgaacaaagggggacgaatgcgagaataaagataaagacaaaaaagcatatttggaagacatggtcgggggctccttgcttctagtgaacaagggccctgagctttagagccctttgtatttattgggtaaaggagatagggagaagggtggggggtggttggtggtcagcagcttgatttacagcaggcttgcaagactgcattatttgaacagtaggctctggatgtcccagtagataacctcaaggcatacagtgccggggagtgattgccctcagcaaaccttctggtggctggagcagaagcaagtttgctcacattctgcattcatgataaacagtttgctgtttgatcatatagcctcagtggaatgctgagttggtcacgacccacgggcattcagctctctatgaaaaggagcctggcatctctcttgctccctcctgccatcggatatgccagctccccctttgccttctgacaggctttctaagcttcctgaggcttcaccggaaacagaacagatgctagtgctgtgcttgtacagcctgcagaaccatgagccaaatcaatctcgtttctttataaattactctgcttcacagctgggcatggtggctcacatctgtaatcccagcactttgggaggccgaggtaggtggattactgaggtcaagagttcgagaccagcctgaccaacatggtgtaaccccatctctaataaaaatacaaaaattagccaggcatggtagggcatgcctgtaatcccagctacccaggaggctgaggcatgagaattgcttgaacccaggaagcagaggttgcagtgggccaagatcgtgccactgcattccagcctaggcaacagagccagaccctgtctcaaaaaaataaaaataaaaaattacccagcttcaggtattcttttatagcaatgcaaaacagactaacacactgtctttttttctcagctgtaaagtgagaataatcattgtgaaatgagatattaaaattctttggaatcatgcctcctcagcagctttacaaggctaccatgtggagttgttcagtgggtatagagtttcagttttgcaacatgaaaaagttcttgagactggctgcacaacagtgtggatatacttaacgttactgaattgtactcttagaaatcgttaggatgaagctgggcacggtggcttatgcctgtaatcccagtactttgggaggcagaggagggtggatcatctgaggtcaggagtttgagaccagcctggtcaacatggtgaaatcccgtctctactaaaaatacaaaaaattacttgggcatggtggtgggtgcctgtaatcccagctactcaggaggctgaggcaggagaatcgcttgaacccaggaggcggaggttgcagtgagccgagattgcaccattgcacgccagcctaggtgacagagcaagactccatctcaaagaaaaaagaaatggttaggctggtacattttatgctatgcattgtttctcagaataacaaaatttttaaggaaatgaccaccacgtgagatacctaaaaagctgtcccaggagagggatgatatttattctgtgagctctgagaggggagacaggagccagttagcaaccactgagtactccagccggcccacaaagccccagcatggatgctgcacctgagtgaggctggccttggagacctctgggccccttccagctcagaggtctgaaggatttgagctgagtcaggtcagcagatgctagaactttccattcacagactgtccagttttgctatatttgaggaacagaaacaggtcagaaagcagggcatgctctcatactactaggaaaacataatgtgatgcaacctttattattatcatttatagtattatttttaaattttgttatttatttattattttatttatttttttttgagatggattttccctcttgttgccccagctggagtgcacttgcacaatctcggctcactgcaacctctgcctcccagtttcaaatgattctcctgcctcagcctcctgagtagctgggactacaggcgtgtaccaccatgcccagctaatttttgtatttttagtagagaccgggtttctgcatgttggccaggctggtctcaaactcctgacctcaggtgatccgcccgcctcagcctcccaaagtgctgggattacaagtgtgagccaccgtgcccaatctttttatttattttattgagataaggtcttgctgtgttactcaggctggtcttgaactcctggccttccagagtgccaagattacaggtgtgagccaaggtgcccagaaggcacaacctttctggcaggcattcacaactaagaacttaatccaagagcacaattggccaagcgtgtgacgttagagaagagcactgttgttgtgaacttcaaccaatgaagatggcctgagaaaaacctgtgacagcttggcagaattcagaaggatgagacatcactccaactgagccacgaaaatatggtctggaggcagggaacataagcccaattcacacttcagctatgacagaaaatatcctctccatttacatagggcgtacaccgagtaaatgactttgtaactttacttcattctcttcttttacatagggtgtacactgagtaaatgaccttgtaactttacttcatcctctttatttacatatggcgtacaccaagtaaatgactttgtagctctacttcatcctcttcatttatgtaggacatataccaaggaactgatggaaacttctagagggtatttaaaccccaaaacattctgtaatggggcccttgagcccctatgctcagcctgctaccacactgtggagtatactttcattttcaataattttcttcatttctttccttgctttgtgcgttttgtccaattttttgttcaagacaccaagaacctggacaccctccaccggtgacacaaccatcaggcaataggggtacacctgggaaggacaagggacagttagtgcagtgaggaatgggaggcagggccgagtctctctgagctgggaggctgctccttctggcctctccaaagcctcactgcttccatttcccgaggcagataaggactgcctcagcctgggacaaaacgacctctctgtgtccacagccacccacaattggcataatgttccagtctcacttcccaggagcctctgaagggcccagcttgggtcagatggccattcctgggccagtcagctatggccaggggatggggtcacatggcacccacatgaagcaaggcctatcccttaagtaggggctgttgagtgacaggaaccgtggaggtgttgacagccgctcctcaaagtatggtcctagactgagcagcagcacttacatcactcggcagcttcttagcaatacagaatctcaggccccaccccacacctaaggaatcagaatctgcttatttatttatttattttgatgataggtgcatgccaccacacttggctaatttttgtatttttagtggagtcagggtttctccatgttggccaagctgatctcaaactcctgacctcaagtgatccacccgcctcagcctgccaaagtgctggaattacaggcgtgagccaccgcacccagcctgtagcccacatattgatcctgtctgttctttttttctttttattattattattattattatactttaagttttagggtacatgtgcacaatgtgcaggttagttacatatgtatacatgtgccatgctggtgtgctgcacccattaactcatcatttagcatcaggtatatctcctaatgctatccctcccccctcccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacttgtgcatgtgtctttatagcagcatgatttatagtcctttgcgtatatacccagtaatgggatggctgggtcaaatggtatttctagttctagatccctgaggaatcgccacactgacttccacaatgcttgaactagtttacagtcccatcaacagtgtaaacatgttcctgtttctccacatcctctccagcacctgttgtttcctgactttttaatgattgacattttaactggtgtgagatggtatctcgttgtggttttgatttgcatttctctgatggccagtgatgatgagcattttttcatgtgtctgttggctgcataaatgtcttcttttgagaagtgtctgttcatatcctttgcccactttttgatgggattgtttgtttttttcttgtaaatttgtttgagttcattgtagattctggatattagtcttttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaacccatcatgaattaatttttgtataaggtgtaaggaagggatccagtttcagctttctacatatggctagccagttttcccagcaccatttattaaataggaaatcctttccccattgcttgtttttctcaggtttgtcaaagatcagatagttgtagatctgtggcattatttctgagagctttgtcctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaattttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcattgagcagtggtttgtagttctctttgaagaggtccttcacatcccttgtaagttggattcctaagtattttattctctttgaagcaattgtgaatgggagttcactcatgatttggctctctgtttgtctgttactggtgtataacaatgcttgtgatttttgtacattgattttgtatcttgagactttgctgaacttgcttatcagcttaaggagattttgggctgagacaatggggttttctagatatacaatcatgtcgtctgcaaacagggacaatttgacttcctcttttcctaattgaataccctttatttccttctcctgcctaattgccttggccagaacttccaacactatgttgaataggagtggtgagagagggcatccctgtcttttgccagttttcaaggggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttagttctgtttatctgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcacaaaatgagttagggaggattccctctttttctattgattggaatagtttcagaaggaatggtattagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcttgctttctctcgtgggcatttagtgctataaatttccctctacacactgctttgaatgtgtcccagagattctggtatgttgtgtctttgttcttgttggtttcaaagaacatttttatttctgccttcatttcgttatgtactcagtagtcattcaggagcaggttgttcagtttccatgtagttgagcggttttgagtgagtttcttaatcctgaattctagtttgattgcactgtggtctgagagacagtttgttataatttctgttcttttacatttgctgaggggagctttacttccaactatatggtcaattttggaataggtgtggcgtggtgctgaaaaaaatgtatattctgttgatttggggtggagagttctgtagatgtctattaggtccgcttggtgcagagctgagttcaattcctgggtatccttgttaactttctgtcttgttgatctgtctaatgttgacagtgggtgttaaagtctcccattattattgcttgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgtttggtagatctttctccatccttttattttgaccctatatgtgtctctgcacatgagatgggtttcctgaatacagcacactgatgggtcttgactctttatcaaacttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtacaagtttttcctttccatgtttagtgcttccttcgggagctcttttagggcaggcctggtggtgatgaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcaatttcaggtacaccaatcagacgcagatttggtcttttcacatagtcccatatttcttggaggctttgttcatttctttttattcttttttctctaaacttcccttctcgcttcgtttcattcatttcatcttccatcactgataccctttcttccagttgatcacatcggctcctgaggcttctgcattcttcacgtagttctcaagccttggctttcagctccatcagctcctttaagcacttctctttattggttattctagttatacattcgtccaaaattttttcaaagttttcaacttctttgcctttggtttgaatttcctcctgtagctcggagtagtttgatcatctgaagccttcttctctcaactcgtcaaagtcattctccatccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtatggatgtcctttctgtttgttagttttccttctaacagacaggaccctcagctgcaggtctgttggagtttgctagaggtccactccagaccctgtttgcctgggtatcagcagcggtgtctgcagaaccgtggattttcgtgatccgtgaatgctgttgtctgatcgttcctctggaagttttgtctcagaggagtacccggccgtgtgaggtgtcagtctgcccctactggggggtgcctcccagttaggctgcttgggggtcaggggtcagggacccacttgaggaggcagtctgccccttctcagatctccagctgcgtgctgggagaaccactgctctcctcaaagctgtcagacagggacatttaagtctgcagaggttactgctgtctttttgtctgtgccctgcccccagaggtggagcctaccgaggcaggcaggcctccttgagctgtggtgggctccacccagttcgagcttcctggctgctttgtttacctaagtaagcctgggcaatggcgggcacccctcccccagcctccctgctgccttgcagtttgatctcggactgctgtgctagcaatcagcgagactccttgggcataggaccctccgagccaggtgcggggtacaatctcctggtgcgccgtttcctaagcccgtcggaaaagcgcaatattcgggtgggagtggcccgattttccaggcgctgtctgtcacccctttccttgaccaggaaagggaactccctgaccccttgtgcttcctgagtgaggcaatgcctcaccctgcttcggctggcgcatggtgcactacacccactgtcctgcgcccactgtctggcactccctagtgagatgaacccagtatctcagatggaaatgcagaaatcactcgtcttctgcggtgctcatgctgggagctgtagaccggagctgttcctattcggccatcttggctcctcctccccatctgttctttttttcttgagacagagtcttgccctgtcacccaggctggagtgcaatggtgtgatctcagctcactgcaacctctgcctcccgggttcaagcaattctcctgcctcagcctcccgagtagctgggattacaggcacgcactactgagaggtgacagtgtgctggcagcccttgcagccctcgctcactcttggcgcctcctctgcctgggctctcactttggtggcacttgaggagcccttcagcccaccactgcactgtgggagcccctttctgggctggccaaagccggagctggctccctcagctttcagggaggtgtggagggagaggcgcgagcaggaacccgggctgcgcgcggggtttgcgggccagctggagttccaggtgggcgtgggcttggcagtccccacacttggagtggccggccagccctgccggccccggcaatgaggggcttagcacacgggccagtggctgcagagggtgtgttgggtcccccagcagtgccggcccaccagtgctgtactcgatttctcgccgggccttagctgcctcccgtcggggcagggctctggacctgcagccccccatgcctgaacctccccccactccctgggctcctgtgtggcccgagcctccccgacgagcaccaccccctgctccacggcacccagtcccatcaaccacccaagggctgaggtgtgcgggcgcacggcactggactggcaagcagctccacctgcggcccgggtgcaggatccactgggtgaagccagctgggctcctgactggtggggacttggagaacctttatgtctagctaggggattgtaaatacaccaattggcactctgtatctagctcaaggtttgtaaacacaccaatcagcaccctgtgtctagctcagggtttgtgaatgcaccaatcgacactctgtatctagctgctctggtggggacttggagaacctttgtgtggacactttgtatctagctaatctagtggagaggtggagaacctttgtgtctagctcagggattgtaaacgcaccaatcaacaccctgtcaaaacagaccaccactcagctctctgtaaaatggatcaatcagcaggatgtgggtggagccagataagagaataaaagcaggctgccggagccagcagtggcaacctgcttgggtccccttccacactgtggaagctttgttcttttgctctttgcaataaatcttgttgctgctcactctttgggtccacactgcctttatgagctgtaacactcaccgcgaaggtctgcagcttcactcctgaagccagagagaccacaaacccaccagaaggaagaaactcggaacacatccgaacatcagaaggaacaaactccggacacgccacctttaagaactgtaacactcaccgcgagggtccacagcttcattcttgaagtcagtgagaccaagaacccaccaattccggacacactaccatgcctgagtaatcgtatttttagtagagacggggtttcaccatattggccaggccagtcctgacctcgtgatccacccatcttggcctcccaaagtgctgggattacaggcgtgagccacggtgcccaaccttatttatttttaattttttaattttaaaaaattttttggagacagtcttgctctgtcgcccagactggagtgcagtggtgtgatcttggctcactgcaacctctgcttcccgggttcaagcgattctcctgcctcagcctcctgagtagctgggattacaggcaggcgccatcacgcccggctaatttttgtacttttagtagagatggggtttcaccatattggtcagactagtcttaaactcctggcctcaagtgatccacccacctcggcctcccaaagtgctgggattacaggcgtgaaccactgtgcccggccaaatttagtactttaaaaaacatttaaaagtctgtttctgtgggtcgggagtttgggtatggcttggctgggtgcgcctggcatagtctctcacggggccacgatcaagttgtgggctggggatgccatcagctaaaggctcaatttggtgagtatcctttctaagctcatgtatgtgtgggtagtccttaggtactcactggcagctggtaagagatgttagttcctcgccatgtctgtaatggactgaatagtatattgccccaaaattcatgtttgcacagaagctcagaatgtgaccttatttggaaatagggtctttgcagatgtaattaagatgagatcgtgctggatgatgttgggccctaaatccaacgactgttttattaagaggagaggacacagagagacacacagggaaggccatgtgaagacagaggaagagcctggagtgatacagccaaagaatgccaaggactgtctggagccaccagaaggaaggagtcttccctgtagccttcagagggaacatggctttgttgacacttttttttttttttttttgagacagtctcacactgtcgcccaggctggagtgcagtggcgtgatcttgactcactgcaagctgtgcctctcgggttcacgccattctcctgcctcagcctcctgagtcgctgggactacaggagtccgccacccgacctggctatttttctgtatttttagtagagatggggggtttcaccgtgttagctgagacggtctagatctcctgacctcatgatctgcccaactcggcctcccaaagtgctgggattacaggcatgagccaccgtgccccaccacttttttttttgagatagagtctcgatctgttgcccagactggagttcacaggtgcggtctccgttcactgcaacctctctgcctcccgggttcaggtgattctcctggctcagcctccagagtagctgggattacaggtgcctgccaccaccactggctaatttttttatttttatttttagtagagacagggtttcaccatgttggccaggctggtctcgaactcctgacctcaagtgatctgcccgctttggcctcccaaagtgctgggagtacaggagtgagccacagtactcggcctctgctgacacattcattacagacttctagcatctggagctgtgaggataaacttctgttgttttaagccacccaatttgtgatactttgttacagcagccttaggaaccaagtgagctggcttccctaagagcagataagtaaaagagtcagagagggccccaatggaagccagagtttttctgctacctaatcttgaacatgacatctgttcactgaaagcaaaccacttgatccagaccacatgcagggcgagaggactacataagatcataaataccaagatgtgagcatcactggaggctgtgaaccagggctgccacaccagcaaaaaacagaggaatttcattggaagaaaccgctttcttcagggttctgccttctccattcattgattccttcgacaaataaatttattaagtacctacaatggactgggtattagggacatatgaccaataagacaaataagattctttcccttgttgagattatttagttacaggataataggaacatctgatttagattaggaaaggagggtatgggcaaggcatgcctttctgaaaaaacattatcaagaattggccaggtgtggtggctcacgcctgtaatcccagcactctaggaggctgacgtgggcggatcacctaaggtcaggagttcgagaccagcctggccaacatggtgaaaccctgtctctactaaaaatacaaaaattagccgggcgtggtggcgggtgcctgtaatcccagcaactcgggaggctgaggcagaagaatcacttgaactcaggaggcggcggttgcagtgagccgagatcgcaccactgcactccagcctgggggacacagtgagcctccgcctcaaagaagaataaagttgaagaatgagtagaaaccaggctgtgtgtgtatgtgtgtgtgttatgagggaagcatgagtttctaggtagtgggaaagcacgtgcaaataagtcggtaagttgaacagctagactaaaagctgcttgagagcagggaccttgtctcttcattgctgcatctctattatacgacatcatctctgcatctctattacaagacatagagcctggcagagagaaattcttactggatgaaatgaatgaataaatccaaggcatcttctataggttagtgcaaaaatgactgcagtttttgccattatttttaaatggcaaaaaccacaattacttttgcacgaatatttcctgttacagatgtcaactgaagtcatttaaaaattttctcccaaagttcatcgcgggatcattgctcttattcatattaggtagcataggcaaagctgctagaacaaaagactcaaagtaagtaaacggtcaacacaagtttatttattctcacataacaatactgagtggatatttaggtcagtaaggcacagttctcctccacttaggaatctcccatcttcaggccttgccttctccagagcctggtcaccatctgcttccagttggcagaaggagtaacagcacaggggagcacctgttggaggtctgtatgggccaggcctggaaactgcacacctcttctggtcactttccgctggggagagcataggcacagagccacacttaaattttactttgaggaatgcagtgtaggtgtatgtccgacaaagaaaacaataattcggtagacaaataagtctccactccaatattcaattacttacttaacttatgctctggtatgtctcaaattaacctagatagaaatgaactctgaatcttccacttccatcaagtttttcactcactcaatggcatcattatccatccagttgcttaagcatacatttgaaagttatccttggtctgtttcttatccttcccttccacatctaatccttcaggaagtcctgacaatgttacctccaaaatatgtcttaaatccatcttctcagccaggcacggtggctcacgcctgtaatcccagtactttgggaggccaagggaggtgaatcacttgaactcaggggttggagagcagccggggcaatgtggagagacccaatctctacaaaaaaaatacgaaaaattagccaggcatggtggcatgcgcctatagtcccagctactcaggatgctgaggtgggaggatcgcctgagcccaggaggtctaggttgcagtgagctgtgatcacgccactgcactctagacagtgggaccgtttaaaaaaaaaaatccatcttctctacacctttaccgccacctccttagttcagacagtgtaataatctctcatctgcattattctccaatagcctcctaatagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaagaccaggttttttgtctgtttgtttgtttttgagacggagtctcactctgtcgcccaggctggagtgcagtggcccgatcttggctcactgcaagttccgcctcctgggttcacgccattctcctgcctcagcctcccgagtagctgggattacaggcgcccacccaccacgccctgctaattttttcttttgtttgtatttttagtagagacggggtttcaccgtaatagccaggatgggctcgatctcctgacctcgtgatctgcccgccttggcctcccaaaatggtgggattacaggcgtgagccaccgtgcctggcccaaggaagacgaggttttaaatcataaagattctaaaagactgccttgacatatccttcttttgttttgggttttgtttttttttttgagtcggagtctggctttgtcatccaggctggagtgcagtgggatgctcttggctcactgcaacctccacctcccaggttcaagtgattctcctgcctcagcctccccagtagctgggactacaggcacgtgccaccacacccagctaatttttttgtatttttagtagaggtggggtttcactgtgttagccaggatggtctccatctcctgacgtcatgatttgcccgcctcggcctcccaaagttctgagataacaggtgtgagccaccgcgcccagccttggtttgggttttattggcacagaggcatgatatgccgcctgaagttatttaattgggttgtgaatcaaagcgtatgtggccagtttttaaacattgtctcctgtgtgccagatggtgtcctagacacaaatggtacaagccagactcctagatgtccctactgtcatgtagcttatattctagagggtggggttactgctaggtggttttaattaagtgtggaaagggtgaggagtactgtgttaaatagggtagtccgaggaggtgacactgtagagttctgatggaaatgcgagagcaagccaccactgtctcagggaagagtataacaggcagtgggaatagcaaggacagaccttgaggtagaagcaggtgtagtgtgatgtaggaagagcaaggtggctggaatgcagtgggtcagtggagatgatgtagagcagcaatgggaagcaaggcacttagggccttgtaggccatcgtaagaactttgggtttgaccctgattaaaaggggaactataggagagttttgaacagaagagagacatagttccaggagataagtatacaaatagggcagcaatgtcacttagtggttgttatagcttctctaggtagactcagttgaaatctcaccctatgtttttttttgatacagagtctcactctgtcacccaggctggagtgcagtggtgtgatctcggctcactgcagccgcctcctcccaggttcaagcaattcttgtgccttggccctccgagtagctgggactacaggcgcacaccaccacgcccggctatttttgttgttattgctattttgttgttattgttgttatattgctagaaaagatggggtttcaccatgttggccaggctggtctcgaactcctgacctcaggttatctgtccgccttggcctcccaaagtgttgggactacaggcatgagctaccacgcccagcccagcgtttctattttattagccgtgtgtctgagtacgacatcacttcacttctgtctcgttagtttcctcatctgtagatgggataaaagcactcccagcttatagggttttttgttggtttgtttgttagtttttgaggattaaatgagcagatatacccaaatgtgcttataataatacctaggccaggcacggtggctcacacctgtaatcccagcactttgggaagcctaggcgggcggatcacctgaggtcaggagttggagaccactctggccaacatggcgagacccccgtctctactaaaaatacaaaaattagccgagtgtggtggcacacatctgtaatcccagctactcagaaggctgaggcaggagaatcgcttgaacctggggggcagaggttgcagtgagctgagatcatgccactgcactccagcctgggcgacagagttagactccttctcaaaaaaataataatacctaacagcaagagctcaatgaatattagctcatagcaacttaagggtgctttagaaagagttgtttttttcacttgactcttgcccagcccaattttcttaaaatttttttagcttttcttcactcagaagtactcaataggtcatggtgaatctacgctaatttgggcatttccagccaatacctattggtggacttgaaaatcagtactgattaggatgtactgctttggaagcaagccagcattacatcaaataaaaaacatttggtctgtggcattgtgttgtattcattgttttgctttttggggggtgttcagcagatggtgagcactgagacaaacctgtagtgttcagctggaaagctattttcctggcctccagccacaacactttaactcttgctgccagactacctgagagtgggttgattggactttaagatctcatcctcccttatccacggttttgctttccacaattttagttacatatggtcaactgcagtctgaaaatattaagtggaaaattccagaaatcaataattcataagtttctttttctttttttttttttttgagacggtcttgctctgatgcccaggctggagtgcagtggcgtgatcttggctcactgcagcctctgcctcctgggttcaagcaattcttctgcctcagcctcccgagtagtagctgggattacaggtgtgcaccaccatgcctggctaatttttgtatttttagtagagacggggtttcaccatgttggccaggctgatctcgaactcctgacctcatgatccaccctcctcggcctcccaaagtgctagagttacaggtgtgagtcaccatgcctggctctcataagtttcaaattaagcactattctttgtagtgtaatgaaatctcttgccatattgcctgggacatgaatcatcccagcatgttcacactgtatatgcttcctatcctgtagttacttagtagtcatcttggttatcagaacaaacagtatgtatagggctcactactatccaagatttcaggcatccactggaggtcttggaacatatcctcccttatctgtggggactactgtactcttaaaaactttaggataaggggctgggcgtggtggcttacgcttgtaatcccaacactttgggaggctgaggtgggtagatcatttgaggtcaggagtttgagaccagcctggccaacattgtgaaacccccatctctactaaaaaaaacaaaaaaaaattagctgggtgtggtggcaggtgtctgtagtcccagctactcgggaggctgaggcaggagaatcacttgaacacgggaggtggaagttgtagtgagctgagattgctccactgtactccagcctgggcgacagggtgagactctgcaaaaaaaaaaaaaaaaatttaggataaggtcaaatggctgtaagtggaggctctatcttctattccctgtatcttctattacctgtatctctagtcccatagccccatgactttgctacacccaaggcacttagctaaatctggagagtgggcattttgggattagggattcttacatattgttttctattatgtatagcgagtcgttaatatttgatggagtttgtgaaaatccatttccttagtttttaaaattaaaaaaaattgtatagtttgtacatcataaaaatacccccaatataaatgtacagttcagtacattcagtgtaaatgttcagtaatttttagtaaatttatagaggcatgcagccatcatcacactctggtgtataatatttccatccctgctagaaagttccttctgcctggttgcagtcagccctgttcccattcctcgccccttacggccactgatttgctttgtcactatagtttttgccttctccagaaattatttccttaatagcttaccaattttatgtgtttgatttcttagcaaatttctcaggttcatccacgttagtgcatgctttagcagttcattctttttattgagcagtagtctttattgcttatccattctcagttataggacatttagattatttctagtttttagctgttgtgaataaagtgataaaactgtacaagttttgtgtgaatatatgtattcatttcttcagtgtagatagctagatgtggaataactgggcagtatagtaaatttatgtttaactttttaagaaaccaccgaactgttttccaaagtggttgtaccattatacattcccactggcagtgtttgaaagtcctgtttttttctaccatcttcacaaatattaggtattttcagtcttcctattttagtccttctggtgggtgtgtagtggtattatgcttttaatttgcatttccctaacgactaatgctgttggacatctttttgtgtgcagatttgacattcatgtttcttttctggtgaagggtctgttccaatcttttgccccatttttttttttttttttttgagatggagtcttgctcagtcgcccaggctggagcacagtggcacgatctcggctcactgcaaccaccgtctcccgggttcaagtgattctcccgtctcagcctcccgagtagctgggattacaggcacctgccatcatgcccagctaatttttgtattttagtagagatggggtttcaccatgttggccaggctggtcttgaactcctgacctcaggtgattgcccaccttggcctccaaaatgctaggattataggcatgagccactgtgctcggcctctttttgcccgttttagaattgcttttttttgttttgagatggagtctcgctttgtcactcaggctggaatgcagtggtacgaccttggctcactgcaacctcttcctccggggttcaagcgattctcctgcctcagcctcctaagtagctgggattacaggcatgcgccaccatgcccagctaattttttgtatttgtatttttatttttttatttattttttgtatttttagtagagatgaggtcttcaccatgttgaccaggtggtctcgtacttctgacctcaagtgatccgcctgccttggcctcccaaagtgctgggattacagatgtgaaccaccatgcccagcctaaaattgatttctttgccttattgagttataggattatttatttatttttttattaatttttttagagatggggtctcacaatgttgcccaggctggtcttgaactcctgggctcaagcgatctgcctgcctcagcctcctgaagtgctaggattactgcacctggccaagagttcttttttttttctttcttttttttttttctgagacaaagtcttgctgctcttgttgcctaggctggagtgcaatggcacgatcttggctcactgcaacctccacctcccgggttcaagtgattctcctgcctcagcctcccaagtagctgggattatgggcatccaccaccatgcctagctaatttttgtatttttagtagagactaaaaattttagttttgccatgttggccaggcttgtcttaaactcctgaccttgtgatctgcctgcctcggcctcccaaagtgctgggattgcaggcgtcagccaccgcacctggcctagagttctttataaactgaataaaagtcatttatcagctatgtgattggcaaatattttctcccagtctgtggcttatcttttcattttataatggtgtcttttgaagagcaaaaggttttaaattttatgaagtccagtttagcacatttttttctttttcttttattttgttaggacagtctcactccatcacccaggctggagtgtagtgatgcgatcacagttcgctgcagccatgtccttctaggcttaagtgattctccctcctcagcctcctgagtagctgggaccacaggtgtctaccaccatgtttggctaattaaaataacttttttttttgtagagacacgggtcccactgtgtagcccaggctggtctccagctcttgagctcaagcagtcgtcacactttggccttccaaagtgctagaattataggcatgaaccaccacgactggttgtgaaatatccttttttttttcatagatggagacttgctctgttgaccaggctggagtgtagtggcgtgatcttggctcactgcaacctctgcctcccaggttcaagcagttctcctgccttagcctcccaagtagctgggattacaggtgggtgccaccatgcccgcctaatttttgtctttttaatagagacggggtttcaccatgttggccaggctggtctcgaactcctgaccttgtgatctgcctgcatcggcctcccaaagtgctgggattacaggcatgagcaactgtgcctggccaaaatacctttttatttcatattgaagatgcagcttttacgtgggtgcgagagtgctataagaaaggcataactatagactctaatatttttcgagaaaaagtcattgtgtcttaaaaggaaggtaaaggatctaaagttggagaatttaatgccagcaaaggatggtttgataactgtagagaggtttggcttaaaaaaatgtcagggtaacaggagaagcagcttctgctgaccaagaggcggcaaacaagttcccagatgccattaagaaaatcattgaggagaaaggatatctgcttgaatgggtttttaatgcagacaaaaatgccctgttctggggaaaacaatgccacaaaggacatttatgagtaaggaagagcagtgagtgccaggatttaaggcaggaagagctaggttaactgccgttttgtgtaaacacagtcaagtttatgatcaggactaccctggtctataaagctgctaacctctgagccttcaagggagaagataaaacaccagctgccagtctgtttttaccaaaagaaagcctggataatgagaacccattttcttttttttttttttttttgagaggagtctcgctctgtggcccaggctggagtgcagtggcacgatcgcggctcactgcaagctctgcctcctgggttcacaccattctcctgcctcagcctcccgagtagctgggattatagttgcctgccaccacgcccagctaatttttgtattttagtagagacagggtttcagcatgttggccaggctggtcttgaactcctaacctcaagtgatccgcctgcctcggcctcccaaagtgctgggattacaggcatgagccaccgtgcccggccaggactgccttttaaagtttttttgacacaatgcccctggccactgagaatcccatgagttcaacactaggctttgaagtggtctacttgtccacaaacagtgtctctaatccagcctgtagatcaggaggtctcaaggactttttgagaaagagtctggctctgttgtccaggttggagtgcagtggggtgatctcagctcacttcaacctctgcctcccaggttcaagcaattctcatgcctcagcctctcgagaagctggaattacaggcatgctccacaatgcctggctaatttttgtatttttaggagagatgaggtttcaccattttgcccaggttggtctcgaactcctggcctcaagtgatctgcctgcctcagcctcccaaagtgctgggattacaggcttcagctgccgcacctggtccaggactttcaagactcattacatgggatactctggaaaagattgttaacaccaaggaagagaatcctgatagaatgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatgacttgatggagatgagtgcttctgtgccagacagtaaggaataagatgtacaagaaacaggggcaggaaaaaattgacattagacaatttgccagaagggttccaattattcaagacttcctttagctttgtttatggaatatggaatggaaccttctgtgatactggcactgaagtgaaagcaaatggtggaagaaggattagtattgtatagaaatgtttttagagaaatggaaaagcaaaaaagtcagacagaaatgaggatgtatttttgtaatgttacaccagatgtgcctgcctctcctgccttcctttccatgcccttcacctcttctacctctgctgccccaagacagcaagaccaaccaactccttttctttctttccctcagtctactcatcctgaagatgggtgaagacctttatgatgatgcacctccacttaatgaatagcaaatatgttttctcttatgattttcttaataacattttttctctatcttactctattgtaacaatatagtatgtaatacataaaatatgtgttaattgactttctgttgtcagtatggttaacaggctattagtagttaaattttgggggagtcagaagttatgtgcagatttttgactgcccagggtgtcagtgcccttaaccttcacgttgttcaagggtcaagtatattatcttatctattaacgtagtagagctttccatttctttagggcttcttcagtttctctaagcagtgttttctagtttccagtgtataaatctataaatcttgccttttgataaatttattctttttttttgagacagagtctcactctgtctcgcaggcttaagtgcagtagtgcaatctcggctgacggcaacctctgcctcccaggttcaagcaattctcctgcctcagcctcctgagtagctgggattacaggcttgcttcaccatgcctggctaatttttgtattttcaatagagacagggtttcaccatgttggccaggctgatcttgaactcctggcctcaggcaatccacctgccttggcctcccaaagtgttgggattacaggcatgagccactgtgtccagcctgataaatgtattcctgttttcttcttcacgcctgtaatcccagcactttgggaggctgaggtgggcggatcacgaggtcaggggatcgagtccatcctggctaacacagtgaaaccccctctctactaaaaaaaaaaaatacaaaaaactagccaggcgtggtggcaagcgcctgtagtccctgctgcttgggaggctgaggcagaagaatggcgcgaacctgggaggtggagcttatggtgagccaagatggcgccactgcactccagcctgggtgacagagcgaaacttcgtctcaaaaaaaaaaagaatggaattgttttcttcatttcatttttggattgtttgtcactagtgtatggaaatacagttgatttctgtatgttgattttgtattttgtatccttagtacatttgcatactagttcttatagatcccttaggattttctacatataaaacaaaatttttttgttttgagatggagtctctctctgttgcccaggctggagtgcagtggtgtgatcttagcttactgcaacctccgcctcccgggttcaggcaattctcctatctcagcctcctgagtagctgggatgacaggtgcctgccaccacacctggctaatttttatctgtttagtagagatggggtttcatcttgttggtcaggctggtctcgaactcctgacctcaggtgatccacccgccttggcctcccaaagtgctgggattacaggcttaagccactacgcccggcctggctgacagttttatcaggaatgggtgttgagtttttgttaaatattttcccttcatctattgagttaattatgtggtttttgttctttattcttaatatagtatatggtaatattacgttattttcagatattaagccaatcttgcattcctggtataaaccccactcagacccacttagtctggtgtagaatcattcttacatgttgctagtttcagtttgttaatattttgttgaggattgtttaatctatattcatgatagatactttcttgtgatgcctttttcgagttttggtatgaatgtaatgctagctttatagaacaagttagaaagtataccctcctctatgggatcattactatgaacatagtaaagattttcttttctttttctttttctttttcttttttttttttgagatggagtctcattctgttgccaggctggagtggagtgcagtggcatgatctcagctcactgcaacctccgcctccctggttcaactgattattttgtctcagcctcccaagtagctgggacttgaggcgtgcgccaccacgcccagctaatttttgtatttttagtggagatggggtttcaccatgttggccagatggtcttgatctcttgacctcgtgatccacctgcctcggcctcccaaagtgctgggattacaggcatgagccaccgtgctcggccagtaatgattttcaatatgaaataaaagggtattttacagccaggtgtggtggctcacatctgtaatcccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgagaccagcctggccaatatggtgaacccccatctctactaaaattacaaaaattagctgggcatggtggtgtgcacctgtagtcccagctacttgggaagctgaggcagaagaatcgcttgaacctgggaggcagagattgcagtgagccaagattgcgccactgtactccagcctggtgacaaagtgagactccatctcaagaaaaaaaaatgcgttgtttaatttcttttttttttttttttcttgagatggagtttcgctcttgttgcccaggctggagtgcaatggcgtgatcttggttcaccgcaacctctgcctcccaggttcaagcgattatcctgcctcagcctcccgagtagctgggattacaggcatacaccaccatgcctggctaattttgtacttttagtagagactgggtttctccatgttgatcaggctggtctcgaactcctgacctcaggcgatctgcccaccttggcctcccaaagtgctgggattacaggcgtgagccactgtgtccagtcgtgttgtttaatttctgaatatgtatggatttcccaactttcccttctgttcatttctggcttaattccatggtggttggagaacttcatataatttattttcaattcatttagttttttttatgatctagaatatggcctatcataagccatttcagattaagactaactttaaattaatactaatagtttcagtaaaatatagaaaatgctccagtttagctccattgtctccctcttctttttttttctttcttttttttttttttgagacggagtctcactctgtctacccaggctggtgtgcagtagcatgatctcggctcactgcaacctccacctcctgggttcaagtgattctcccatcccagcgtcctgagtagctggaattacaagtgtgcaccaccatgcctgtctaatttttgtatttttagtagagatggggtttcaccattttggccaggctggtctcaaactcctgacctcaggtgatccacctgccttggcctcccaaaatgccagggttacaggtgtgagccactgtgctcagccttctccctcttcttttgtgttactgttgtctatgtattatatatgtatatattacaaaccagaaaatacagtgttgtagttatttgtttatgcagttaaatcttatgtgttttaaataagagagaaaggaataaaatatatttacagccttttatgttaacctacagtatatttaccatttttgttattcttcattttttccctcttgatccaagttactatctgatgtaaattctctgttgattttctggatatgtatttttgaaatgcttttatgaggattataatatgcatctttaatttatcacagtccactttgggttaaaattgactaaagtctggtaatatacagcacctttgctccaaggtagctctatttcctcctttctcccttgtgttcttattgtcatgtatatctttatatgttataacctatcttatgtatatttatgaaattaagagaagaaaataattttttccatgtttacctgttctagtactttctgttccttcttgtggatccaagttttcttttttcttttttttttttttgagatggagcctcgctcccgttgcttaggctagagtgcagtggtatgatctcggctcactgcaacctccacctcccgggttcaagcaattctccttcctcaccctccgtagtagctgggaatacaggtgtgtgccaccatgcctggctattttggggttttattttgtatttttagtagagacgaggtttcgccatgttggccaggctggtcttgaactcctgacctcaggtgatccctcccatcttggcctaccaaagtgctaggattacagacgtgagccaccgtgcccggcctgatccaagttctcatacagtagcattgccattctctccaaaggacttcctttggtagttcttgtaggccaagtctactagcagtgaattctttcagtgtttatttatttgataatgcctttatttcactgttaatttttgagggatagttttgttcaatatagaatttatgcttgacagttgttttttcagtactttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgatccgcccgccttggcctcctaaagtgctgggattacaggcgtgagccaccgtgctcagcctgttgagcacctctgatcagtttttcatgccagtcattataatttttaactctagaatttccatgtggttcctcttcattttttctgtttctcggctgaaaatctctatttatcattattttttacttcgtcatcagttttctttaattctttggacgtttaaaatagttgcttttaagtgcaactacttgctcaatctagtatctgcatccaatcagagatggatgctattgatttctctttttcctgagcttaggtgacactttcctggtttttacaagtctagtaattttggttgaaaactggacatttagataatatagcaactctggattctgagttttcccccctgtggcttgttatatttacagttaattgcttagaattaaaccagaatctatttttcctttggtgtgctaatgtctctgcttagttttaaattattattagttttttcgagacggagtctcactctgtcaccaggctggagtgcagtggcatgatctcagctcattgcaacctccgcttcccaggttcaagcgattctcctgcctcagcctcccgagtagctgggattacaggcacccgccaccacgcccagctaatttttgtattctcagtagagatggggtttcaagctggtctcaaactcttgacctcgtgatcctcctgccttggcctcccaagtgctgggattataggcgtgagccactgtgcccggtcaattttaaaatttttattttcagctgggctcagtgtcctacgcctgttatcccagcacttctttttttcttttcttttctttgcttttcttttttttttttttgagactgagtttcgctcttgttgcccaggctagagtgcaatggcatgatctcagctcactgcagcctctgcctccctggttcaagcgattctcctgggttagcctcctgagtagctgagattacaggtgcccaccaccatgcccggctaattttgtaattttagtagagacggggtttcatcatgttggtcaggctggtctcgaactcctgacctcaggtgatccacccgcctcagcctcccaaagtgctgggattacaggcgtgagccaccgtgcccagcgaatcccagctacttgggaggctgaggcaggagaattgcttaaacctgggaggtggaagttgtagtgagccgagattgcgccatcgcactccagcctgggcaacaagagtgaaactccgtctcaaaagaaaataaaatattttcattttttcttcccagcctggcttttggtgggttgtccctgtatctgtttaacttagttgtcagccagtgatttgggcagaggttctcaaatactttcagcccctgaggcttttaccctatcctgatcaacttacagtcaaatgctctactgctgagctatacccccctgatcaatgtgtatgtgggtttggagaaactctaaaaaattgctgctggctctaaagtctcctttggttttcagtttttcctggttctcttaggtataatttcccagtcagtgatggtcatgtgaagagcttaactcagactttctatggctctgtttcaggattttcccattaaatctctggatgttctgcccatctaacaaagacaactgccaaagctgttcatttccatccacattcaccacttttagctggtagatccatgaattttcttcctcaccccaaattgagtccaccccctagagcagcagaactgctgattttcatagctggccccatgttgggaaaactagcattgtcaccagctgactatgctgtaagcagtggggatagaggagtagaaggatggcaggatcctaggctagaaagcttactatttttacctgaacctctagcagattttcaagaatctgtacttctcagtttgtttgatttacactgtattgaaatagttctttctgacaattttaatttttaacttttccattgtggcgaggaattgcctaccacttcatgctgtgaatacaagaatttctatgcctgtaatcccagcacaggcatggaaattcttgtattcacagcatgaagtggtaggcaagtgaggccgaggcaggcagatcacttgaggtcaggagttcgagaccagcctggccaacacggtgaaaccctgtctccactaaaagtacaaaaattagctgggtgcagtggtgggcacctgtaataccagctactcaggaggctgaggcaggaaaagcttgaacccaggaggtggaggttggcgtgagccgagatcgcgccactgcacaccagcctgggcaacaagagcgagactccgtctaaaaaaaaaaataatttccattttttcttagtttttgagcttcagagaatgactagggtctgccttactagagataaaggtaagaatagaggactaatgcccaggccacttctcaaacaagtagtattagaatcccctttgtgtcaggtagtttttttgttttttttgttgttgttgttttgtttgttttttgagatggagtctcactctgtcacaggctggagtgcagtggcgtgatctcggctcactgcaacctccgcctcccaggctcaagcgattctcctgcctcaacctcccaagtagctgggattacaggcgccgccaccacacccggctaatttttttatttttagtagagatggggtttcaccatgttggtcaggctggtctcgaactcctgacctcatgatctgcctgcttcagcctcccaaagtgctgggattatgggcatgagccaccatgcccggcctgcatcaggtagctttaaaaaaatcttctcaggcgattgtgatgtgcagttattgttgagatccagcagtttagaacagtgtttagaaaagcaagctttctctgtaaagggtgatataggaaatattttaggttttgcggtccctgtggtctctgttccaacccctcaactctgttgttgtagtgtgaaagcagccaaagacagtatgaaagcgagtagatatggctatattccaatacactttatttgcaaaaacaggcaatggctgaatttgctgaccccttgtcttggagaattctcaaaaatgattttattccaagtgtttgtatccttgttaatttaaggtagtgtgtatatttcttagcacaacccagcctttgcatttgtcattgatgtctttgaagaattagtccataatttccttcagtagaagtgttttaattgaccatgccttcctaccttctcctttgtcattaaaatatgtgagaaaatgtgccagccgtgggcaatctagttgaaaggtgtgtgttaacttttttggcccagttgggctcagtgaagccttagctggctagtgtttatggcaccatcaacaaagatggaagaattaagcctgggaaaaaggacaggaggtataaaaaatggggtccagaaattcagctgtaggagagcctggtagtggttctcctaccttctgcaaagttcagtgtcaaaactccaatcagagtctctacaagttgaactttcttggctgtccatcaggtagagtactaacttagtaagtacagtggagggccgggtgcagtggctcatgcttgtaatcccagcactttgggaggccaaggtgggcggatcacctgaggtcaggagttcaagaccagcctggccaacacagtgaaaccccatctctactaaaaatacaaaaattagttgggtgtggtggtgcgcaactgtaatcccagctacttggtaggctgaggcaggagaatcgcttgaactcgggaggcagtgaggccagatcacgccattgtgctccagcctgggcgacagagcaatactctgtctcaaaaaataaaaaaataagtacaatggagaatttggtcagacaacttatttttacatccgaggggttgggcatatgaactctgattataatgaatagttcagtagaacaaatcttattttccatagagtctactgtgagtgtatgattccattagttgagtggaacagtttttaccacgatgcttaaattctgcttcaactccctccttcccactactctattcccctgggtctcgtcagatactcctaagtcaaacaggtcatgtagcagataagtgaaggaagtaggcaggttaagtgggtaggtttgagttctgttgaggaggtggtgagtgaagatggagcctaggacctctctgattgggcagtacttgttcctaatctttatgctggggcctgggcagttacccttaatagatggaaaggtgcttagggtaggggatggtagaggacgccagagccatagattatagcctagatagtgcccataactcactgtgtgaccttgacaagctccataatcctgacgcacagtttttcagaagggagtttgtatagcgatcttttgggtcctcctaactcaatatcccttcatcacaaggctttagtctgcctttctagggattaattcctttctagtcattcattccatagttatttactgtatgctgagaacctttaccaagaattggacacagaaaggggtggagatgaagactttccaagcctggcacattcactggatagaggccttgttttcatacctgaacttagcctggtatactagctgctcagtgagtgtgtattacgtaagcaaatatcctattcctgtatactagcgagcgggattcttgtgctacatagtctatcagattttcattgcaacaaaacaacgtgaaagtcttatggattttgatttttttttttttttttgagatggagttttgctcttgtcgcccatgctggagtgcaatggcgtgatcttggcccacagcaacttctgcctcctgggttcaagccactcttctgcctcagcttcctgagtagctgggattacaggcatgcgccaccatgcctggctaattttgtatttttagtagagatggggattctccatgttggtcaggctggtcttgaactcccacctcaggtgatcctcccacctcggcctcccaaagtgctgggattacaggcatgagccactgtgcccggcaggattttgatttcttaaggtctgcagttggtttcctattttacctgtggaagcctgcaaaaatgaattttagactatcacaatttaaatatgtgactttcttgcctgtaaccccagctatttgggaggctgaggcaggaggattgcttgaagtcaggagtttgaaaccaacctgggcaacatagcaagaccctgtctctaaaaaaagaaaaaagaaaaaaattagccagatgctgtggtgtgtgcctgttttcctagttacttgggaggctgaggtggtaggatcatttgagcccaagagttcaaggctgcagtgagaaatgatcacaccactgcactccagcctgggtgaccctcggtcttctcggctcactgcagtctccacctcctgggttcaagcaattctcctgcctcagcctcccgagtagctgggactataggcacgcgccaccacgcccagctaattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcctgcctcagcctcccgaatagctgggattacaggcatgcgccaccacgcatcttgtatttttagtagagacagggtttctccatgttgatcaggttggccttgaactcctgacctcaggtgatccatccgcctcggcctctcaaagtgctgggattacaggcgtgagccactgtgcccggcctttagtttttaaaaatatacattgggtttgtttttgtttctgtttgaaaccgagtcttgctctgtcacccaggctggaatgcagtggcacgatcatggctcactgcagccttgacctccttaagctcaagtgatccttctacctcagcctcctgagtagctgggaccacaggcatttgccaccatgcctggctaattttgtttgtattttttgtagacatggggttttgcatgttgcccaggctggtctcaaactcctgggctcaagtgatccactttggcctcccaaagtgttgggattacaggtgtgagccactgcccctggttatacattggttttaaactatctggatatggtaatgacattctaataacatgtgcaatgaaggacttcttttgcataaagaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaaatcaaacaaatgggaaaaaaacgcttatttttcacaactgtgctctgttggtgaaagcatttggatggaagctggaagcatatatgaaagaatggtagccaaaaatcacattaaaattttttttttcagaacatgagaatttttgctcttagtaactgtgttaccctggacttaggaagttgttacacactttgtagatgcagtatctttaggtcagcttcttaatgtttcagggttttttgtttctttttcttttttttttttttaacttaacaaaatcaaatgctttcaaacagggcccgactcttaattgtaatggagatgatggaagggggagagctatttcacagaatcagccagcaccggcactttacagagaagcaagccagccaagtaacaaagcaggcaagttaaccccaggtaccaatcaaactgccaccaaagttggttaacaagcacaatttcattggggggaagaaaagaaaacttaaagaaaagctctatttgacttctcattgcctgctttgttatgtaatcagaaaagatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaatttcaggatgccccagtgaagttgtgtgactttggatttgccaagattgaccaaggtgacttgatgacaccccagttcaccccttattatgtagcaccccaggtaagcatgtgcggtttctgtcctaagatctgtcaccaagctgcccatcaactcgtgttccttctattctacagcacaagtaggcatatattacagatgggagggggagaacttagctttagaaacctacagattgctttatttggtgtagatcttttattcttttaaaatcaactttagccaggtgcggtggctcacgcctttaatcccagcactttgggaggctgaggcgggtggattacaagttcaggagatggagaccatcctggataacacggtgaaaccctgtctctactaaaaaaaatataaaaaattagccgagtgtggtggcgcacacctgtaattcgtgctactcaggaggctgaggcaggagaatcgcttgaacctgggaagtggaggttgcaaggagccgagatggcaccactgcactctagcttgggcgacagagcgagactccgtctcaaaaaaaaataaataaaataaaataaactttattgaggtatgatttagaagtatgatttacatacagtaaaatacctccacttcaaggagagtttgatgagttgtgacaaatatataccccatatggcgaccaccacattgaagatgtggaacacgcccctcacttcacaagctgcctgtgccactttgcagtcagtcccctcccaacttaacccctggccctaggcaaccactgacatgctttctgtcattattggttagttttgcctgttgaagaatttcagaaaaatgtaatcgtggactttgtatgcttcatttcttttgcttagcatgtttttgagatttgtccatgttcctgcatttatcactcgttaattccttttcattgccaagtagtatttcattatatacctaagctgcatttgttttttccattcactgacaggattttgggttgtttctcatttttggctattatgaagaaagctgctaggaacacttcttttacagtttttgggggacatgttcccccatgcccatatcttttttccaaaatggctataccattttatgcgtctaccagcaacgtatagagttccagtcatttcacatttttactaacgcctcatgcttgttgcttgtcagcatttgtcatcttagtcattctggtagcgggcagagtattacttcattatagttttaatcacgacattgtcctgatggccactattttggagcactttttgtacatgtgtattggccattctgttgtaagtatgggcattcatcttttgccattttgttattgttggtttcttgttaaagaattgaggtataagaattttaaaatattctggacacaggttctttgccatatgtatgttgtattcttactgctgctgtaacatattgtcacaaacttagtagataaaaacaacagaaatgtattatcttatacttctggaaatgagaagtctgaaatggtactcagtgctataatcaaggtgtcagcagggctgtgttccttctggaggcatttcttgccttttccagcttctagaggctgcctacattatttggcttgtagcctcttccttcatcatcagagccagtagcatagcatcttccaatgagtgtctctctctatgactttgaccctcttgcctgcctcttataaggaccctactgatcacattggccttacctagataactccccattttaagattcttaacttaattgttctgcaatacaaggtaaaataatcccagggattataacatggacatcttggggggccattattctgccttccatatatatatcatgaatattcatctcagtctgtgacttgccttttaattttcttaatggcctttgaatagcagaagttttgaattttaatgaagtctgtttcaccattttttttttaatgcttagtactttttgttcctaagatccacaagcataaatattttctctgatgttttcttataagaggttatagctttagcttttacatttgggtctgtaattcatctgagtttgtgtgtgtatgaaatgagagaccaggttctttttttcccccttaagggtgtcaagttgttgcagcatcattggtaaaatgttttttacaaatcatcatttgtaaaaggatttgtaaaaggattgcatcattgaattgcagttttttgtttgtttgtttgtttgtttttgagacggagtttcattctttttgcccagcctggagtggtgcaatggcgcgatctcgactcactgcaacctctgcctcccgggttcaaggaattctcctgcctcagcctcctaagtagctgggattacaggagcccgccaccatgtccggctaattttttgtatttttagtagagacggggtttcaccatgttggccaggatggtcttgatctcttgacctcgtgatccgcctgcttcggcctcccaaagtgctgggattacaggcatgagccactgcgcctggcctgaattgcagttttgttgaaaaccagctggccatatatctgttggtcttttctggattctattctgtttgtttaatatatgtatgtgtctatagcaagagcatctgcattattgtagctttatattatatcttgacttcagattcattctttttcaaaattgttttggctattctagatcctttgcatttctctacattttagaattcacttctgtataacagaaaagcctcctgggatttgactggggtggtatttaatctataggtgaatttggagagaactgatatcttaacaatataagtctcccaatcgatgaacaaggtatatatctctccatttgtttaggtctttaattttcctaaaaaatgtttatgcttcttaatgttacaggtcttgcacatattttcttaaatttatccttaaattttgtttttggatgctgttggaaatgatattgtaaaacatttcagctgggcgtggtggttcacgcctgttataccagcactttgggaggctgaggcaggcggatcacctgaggtcgggagttcgagaccagcctggctgccatggtgaaaccccatctttactaaaaatacaaaaatttgctgggcgtagtagccggtgcctgtaatctcagctacttgggaggctgaggcaggagaatctcttgaacctgggaggtggaggctgcagttagtcgagatcatgccattgcactccagcctgggtgactagagtgaaactgcgtctcaaaaaaaaaaaaattcattttctaattttaactagtttatagaaatactagtgttttttgtttgtttgttttgggtttttttttttttttttgagatggaattgcactctttgttgcccaggctggagtgcagtggcgcaatctcagctcactgcaacctctgcctcctgggttcaagcaattctcctgtctcagcctctgggatgacaggcgcccgccaccacacctggctaatttttatatttttagtagagacagggtttcaccatgttggccaggctggtctcgaactcctgacctcaggtaatccacccactttggcttcccaaagtgttgggattacaggtgtgagccactgcccccagccatactagtgactttttttttttttttttttgagatggaggcttgctctgttgcccaggctggagtgcagtggcgcaatctcggctcactgcaatctccgcctcccaggttcaagcgattctccttcctcagcctcccgagtagctgggactacaggcgcccgccaccacgcccggctaattttttttcatatttttagtagagacggggtttcaccttgttagccaggatggtctcaatctcctgacctcatgatctgcctaccttggcctcccaaagtgctgagattacaggcgtgagccactgcacccggcccatactagtgatttttgtatattgactttgtgtcttgggaccttcctaaattcatttattaaatctagtaaattttttgtagatttattaggattttcttttttttctttttcttttttgagagcctaaaagtgggcatgcctcttctgttgctcggcctttagtgttgggtttgagggttaaatcagtctactcaaaagttgagctgagtgtgagttttgttgttgctatcgttgtcttcagtgcctcagtggcatgggattcctgttttgttaccttatggttaggtgggatctgaaatgccattttttttaaaatttaaaaaaaatttttttaaaatattccacttctaccctcagtcttggccttgctagtgcacctgtacctcagaggggatctctctttacagtcttggcccccccttagcaatagattgctgtcagttactgcttggtccctgcaagcctgcagaaagggagatggcaatgggggaccgagaggtatctgtttctctgctgttgggcaggacctgtgttcttgagtctcatgaatatctggtggaagtctgtgcagaagagtatgggagcaggcatgagtcttccttgtttgtatggctcctagagggtctgtactcttatcctagcccacattttgcctttagcagtttgttaaaaacctcgctgaattctttttacccaaatggcatgtgatatcacttcctcctgcgctctgccataggtgagccagctttcactccccatctctccttggaagggcctgacttaaagatttccgaataattggttaacctgagacctgatctttgatgggttcaaaaaaagtgatgggccgggcgcagtggcttacccctgtaatcccagcagtttgggaggctgaggggggtggatcacttgaggtcaggggttcaagactagcctggtgaacatggtgaaaccccgtctctactaaaaagacaaaatattagtcgggtgtggtggcagccacctgtaatcccagcttctcgggaggctgaggcaggagaattgcttgaacctaggaggtggaggttgcagtgaacaaagattgagccattgcactccagcctggtgacagagcgagactccatctcaaaaaaaaaaaaaaaaaaaaaggatgattttataatttatctttgacactttccagctttctatatcctagcagaaacagaaatcccaacaatttgggtggaaggagggtgaggatcaaaaaactacctatgtggtattatgcttatataaaacctgggtgatgaaataatctgtataccaaacccctgtgaagacactgcagttcacctatataattaacatgcataaagcacatgtacccctgaacccaaaataaaagttaaaaaaaaaaagtcccaacaatttgattatgtatgcattcttgttcctttgtttttcctgccagggatctcttgagctcctgggatctgttggtttatggtgtttatcaaataaacaccatatcaaataaaaattaggaaatttttcagacatcatctcttcaacgatttttctactcctctacttgttttctgagacttccaatcaatgacatatatattagactgtacagggaactggagttctgatcttttgtattttcatccttttttccttttctttcatccttttttttctttctgctttcccttcccttcttcccttctgatatatactcaatagtggcactgctggatgataaggtatttctagttttaatttttttaggaagcttcccactgttttccatagtggtcatactaatacacattcttacagtgtacaaaggctcccttttttccacatcattgttaacacttgttatcttttatcttttttaatagccactgtaaaaggtgtgaggtaataatttcattgtggttttaattttaattttaatttttttttttgagatggagtcttgctcctggcacaagttggagtgcagtagcacgatctcggctcactgcaacctccacctcccgggttcaagcgattctacttcctcagcctcccgagtagctgggattaaaggcatgtgccaccacgcccggctaattttttgtatttttagtagagacagggtttcgccatgttgttcaggttggtcttgaactcctaacctcaggtgatccactcgccttgacctcccaaagtgctgggattacaggtgtgagccaccatgcccagcct

SEQ ID NO: 584 - DNA, 134304 bp, Homo sapiens
atcatttaaaaaaagaaaatggctgtctctttagaactatcaatttatccatttattgggtacagtctcttggggacatggaagtgctagaagtaatccaggagagctggctgtgaaaaagttcactgtgaggagacattgtacacatagcaatctggatgtgtctcagatgcagggctcagagtgatggaggccatactgaaaaggccacatgctgagtgacatatgtatttatgggacatcctggaagagacagactacagaaacagagatcagtgggtgctggggatcaggggggcaggggttgagtacaaaagtacactggggaaatttccagatgatggaaatattctgtttttttttttttttttgaaatggagtctcgctctgttgcccaggcaacctccgcctctcgggttcaagtgattctcctacctcaggctcccaagtagctgggactacaggcatgtgccaccatgcctggctaatttttgtatttttagtagagacaggtttcaccatgttgaccaggctggtctcaaactcctgacctccggtgatccacccgcctcagcctccaaagtgctgagattacaggtgtgagccattgcgcctggccgaagtattctgtatcttgatggcaatggtagttacccaactatggatttgttaagacttgcagagttctacattaaggaggtgtatgtacaccactcctcaatttttttatttttatttatttatttttttgagatgggtgcctcactctctcccaggctggagtgcaatggcacgatctcggctcactgcaacctctgcctcccaggttcaagcgattctcatgccttagcctcctgagtagctgagattacaggcacacaccaccatgcctggctaatttttgtatttttagtagagatgggggtttctccatgttggccagcctggtcttgaactcccgacctcaagtgatccgcccacctcagcctcccaaagtgctgagattacaggtgtgagccaccgcacctggccaccttaattttttttaatggggaaaaatatgtttgtaaaaaaagtcttgatgcacattttacaagaagaaagagacgctgtgagagccaaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccaggttcaagcgattctcctgcctcagcctcccgagtaactgggattataggcacgtgccaccatgcccagctaatttttgtatttttaatggagatggagtttcaccatgttgttcaggctggtcttgaactcctgactttgtgatccgcccgcctcggcctcccaaagtgctgggattacaggcgtgagccaccatctctctcttttttttttttttttttttttttgagacagggtctcgctttgtcacccagggtggaatgcagtggtgtggtcatagctcactgcagtctcaacctcctgggctcatgtgatcctcccacttcagcctcctgtgtagctgggaccacaggcacagccaccatgcccagctcctcatatcatttttttgggcacacgtgcatgtttggttgtctgccttgtttcctccaatccctttcattgttttccacggttcaaaataaaatgaaatcttccactgtggtttcctgacttattttccccatgataggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtggactttctgtgtcatacaaagagaatcgagtggagaggttcccttcagcgccttcatgcctcctcctgcctgtgtttcctcgaggtccaggccatcatctcagccccatacatgctgggagcacagaggccacgggtccgataagtcccgagttggctgccttccctcactatgtagcccggggctctgtgctcatacatactttacccaggagctggcatgtgaggcccctgcagcctccacctgctccatagtcagaatatctgggcgaaggggaggtggtggcccattcgccattacactttggagcacaatctctcttctctgaggagagtggaaatgcttactcacttgcagtctgagctccttgagaaacccagcgacatgcagaggtgagccaggggcagtgaggccccagcctgctcgtctcataactcgtggtggggtagccaaaactcgtctcaggttagaccagacgggcaggaaccatcccccccggctgccaccttgcagaggtgaccctgtgggaactgccttccctgagaatggccagccaggatcagcaccatgaggggcccgtgaatgggctcctcagacccacatgcccaggggtctggggaggcaggtcccccttcaccacacttgagaaactgcttgttgctcaaggaagttaaaccccaaacaaatgcctgtcacaatgacagccacactggccaggagcccactgctaagctggcaggagcgcagcagctgagtgctccctcaggctccgggaggagaggttttcttcaaaaaaaaggaagtggtcgtggcctggcctgtctcatgggcctaagaatgtctttcgtggcctctgaggttaaccttgcctgttcagtaacgcagctgctgagaggaaaatgggagtcaggctgtgggtacccccatatctccctcagatcctctgccttgagggctagagaccccgggggccccaggaatgctgcctgcagacaggcaggtcccccccaggccctccacctctgctagatcattctgcccaccactgtcgagggagcctcagctctgggcccagcaggagtccaggccttggggaatgtgcaagtaaacaaaacaggacaactgctggcctttgggggtttgcatctcaagtaggggatggcggttagtgccccagaggcctgggcgtgtgatggggcaagcactgctggggctggaggctgaggggaggactctttccagaagaggtgtctcagccaaacctgcctgacaagaagaaagggcaggctgggcgccgcgggtcacacacataatgccagcacttcgggaggccagatggtgtctggatgccaagacctgtgctcgccaaggcctgatttcagataccgtcagatcattccacaacaatcctacagaggctgcaaagagacacttccaggcaacttgtctgggcagggccccttcaagacggcagctgggagtgacaccgaaagaacaggctccagtgatctctgctgcttgtacccattgtcagtcccccagggttgtcggtcaccacccagggcttcagagttccccagggatgcctcgggcgtgccaaggctgtcactcagagacccctcttgttggtatttctgctgccctccctgctgcgacataggtacagatttctccccttcgtccattttaccaaaatggatgcgcgttgggacaggtgagtcccggactccagcggcctggggcccacacctgcaagtaacctgggacagggtttcttttaatcaagttgactgagtggagaaatggcccaggggattttctgtcctatcagtgttagacggatgacacagtggtgaagagctgtcagaggtaaaggcggacactaaagtggtagggacaggttttatttatttttctgagacagagtctcactctgttgcccaggctggagtgcattggtgccatcttggctcactgcaacctccacctcctgggtttaagcagttctcctacctcagccttccgagtagctgggattacaagcatgcaccaccatgcctggctaatttttgtatttttagtagagacagggttttgccatgttgaccaggctggtcttgaactcccgatttcaagtgatctgcctgcttcaacctcccaaagtgctgggattataggcgtgagccaccgtgcccagcagggacaggttttaatcagtcataagccattgctttagagagcagggcccagcgggaactgagctccacttggatttgtgcggaggtgatgggaggggtggtggttgggaggggggctcaagagtcaggaaggggaaccagagagagcaggaaggagtgtggttggcgtgacacctgtctgggtttgctaactggcgcttagggttaggctcctgccctcccttggaggctgggggacagggtccatcttctagtgttgctggaacaaacagtaatttctttcagcagctttgggctttctcaggcaggtacgggcatcccacagatgtggtcttgagatgttggacaccatgtaacttaagtcttttcatgggagtatgggggtgtggacttaagcatttgtgctgaaagtctgcagttttaatatgccaagtttgaggtctagtggagatgggagttcagaggaaggctggcgagagcgtgctcaaggagagaatttttgtcaggactgtggctctagattcaaatggcccaaattcaaatgggtttaaatcctgactctgtgacagagtagctgggcaacctttggaaatgttccttcatcttagagacttagatctctcgttttatttatttatttatttaaattttttttaagagacagaggtctcaccatgttggccaggctggtctcaaactcctgagctcaagcaatcctcctacctcagcatcccaaagtgctgggattataagcatgcgccaccacacccggccagatttctcatttgaaaaatgagtagaccagtccttgcttcccagaatcacctgaggattaaatgggatgatgtgtggcttaccataagccacagcacacaccagctgttcgtgtgtggctggagtcaggagcgggacccgctaaagaggaggcggctgtgctcacattggagtgcaagaatgtggggcctcatctgggctgaggactagcctggaccacataagatgccatgcttctcacactcaactagcaaaggaatgcccctgcgatcaggttaaaatgcagagcgtggtgcggtgggcctgccttcctaacacacttgcaggtcatgctccttgttttgggacccactttgagaagcgagggtgagaagggcttgacttccctaacctgatccccaggggaggcagaatgagcagacaccgcctggctagaatcataagagctactgggtatttagtacataccaggtgccaagaactatctgtatattattattattattgttttttgagacagagtctcactctgttgtgcaggctggagtgcagtggtacgatctcagctcactgcagcctctgcctcccgggttcaagtgattttccagtctcagcttcctgagtagctgggactacaggcacgcaccaccacacctggctaatttttgtaattttagtagagacggtttcaccatgttggccaggcttgtcttgaactcctgacaggtgattgacccacctcagcctcctaaagtgctgggattacaggcatggccactgcgcctggccagttattttgaaccctataacaattggcagatccttttattctgcccctgctagagatgaggagacagaggttcaaaggaattgtgcaacttgcttaagatcacacagcttgtcagtgaattcaaacctaaattcagaagatcccagagctctttctactccatggcatggatcgttaagatcacctctgtgaggtactggcctcctcacctaggaaaggaggaagatgatgaggctcatgtcaccaaggagagcgtgctgtgccctcaagaagtgcatgagcttctgatgcttccagaataatctccgggatgcccccccgactgcctcttagggggtcaggctccatgatgggggtgtctgccctgtggccctggctgcctgtggagtgtcaagccagctgtgtgtccgagagagagagagattgtgtgtgtgtgtgtgtgtgtgtgtgtgtatgtgtgtgtgtgtacatatgcaaacaaggagggcagagctggggctcagggctgaccatatttttcctcctacctgtgagggcagatgtcttactgtgttttgttttgttttgcttttgagacggagttttgctcttgttgcccaggctggagtgcaatggcattatctcagctcaccgcaacctccgcctctcgggttaaagcgattctccttcctcagcctcccaagtagctgagattacaggcatgcaccactacacctggctaattttgtatttttagtagagatggggtttctccatgttggtcaggctggtctagaactcccaacttcagatgatccgcccgcctcggcctcaaagtgttggattataggctgagccactgcccccagccagatgtcttcctgttaaaatggggctttaaattcctcacctaacatcattgtttgcaacaacagcaacaaagagcttccatagacagagtcagtgtcccagaacggggactaaacaaccaaacatctagaatctcaccagtcagtgaccctgaaggagacctcagtcacaacctttgttggagagcaagtggaactagggttttttaaagcctgaaagcacatcagttgtgccctaacaatgaaaggtttcagagtagttgaaagctaggaatttgaatatcttagaggaagttaagtggcttgaggtgcttccaccgaaggtctcagcaccatgagaatgcctgtgcttctgccggccccattcctgccagtgagcccacagacaaggggcgatgaagaaccaggaaacagatggaaagaaacgtggaagagaggaaagcctcagactgtcagggtgaaatctaggttgagagttaagttttagttcattctttggagagactgagccacaaggagccataattacaatagcgtttcagcacatccaggtgatcttggtctgcagtatttggttgaggactgtgtgaaagcagctgaggccaaatgtggtggctcacacctgtaatctcagcattttgggaggctgacttgggtggatcacttgaggccaggagtttgagaccagcctggctaatatggtgaaaccctgtctccactaaaaatacaaacattaaccaggcatggtagtgcatgcctgtaatcccagctacttgggaagcttgaggcaggagaatcgcttgaacccaggaggcagaggttgcagtgaactgagatggtaccactgcactgcagcttgggcaacagagagagactccgtctcaaaaaaaaaaaaaaaaaaaaaaaaagcagctaaggaaggctactatggtcacaaaagacttcccagaagatgggacttgggctggatcttgatagggaagatttccataaggagagagggcaggacatgggtggaacaggtgcaccaacagtagggcaccagggatgagagagctgctggttaggattatggtgagcaccacagaccacagacaaaccagaataaacgaacctgtggaccagcgtgtcctgcactgagacacacaccacgcacaccaacagggacgaagcacgttgcccacattgtatcgatgtatgcgaatgtggataagtcagctcattttctccttcccctccccacaaccaagtttactgctgctcctggctcccccatcctggggaatagcacatggtaagaacctcagcacccactccactcctctcgccctcatctccacacagctacctgtcaattccaccttcacactctttctgccaactgagccctcctcatctctctgcctctggcctgcctccccactacaactgagtttccatgcagttctcagaggaatccctcgaaggcacatgtgcaacctcatcacttccaggctgaaagatcttggttaagagaaatattagtacaagctattaagacttaggaggctgccgggcatggtggcacatgcctgtagtctcagcattttgggaggccaaggtgggctgactgcttgagcccaggagttcaagaccagcatgggcaacataaagagaccctatctctacaaaaaaaaaaaaaaaaaattagctggtgccttagtccgttttcatgctgctgataaagacatacctgagactgggcaatttacaaaagaggtttaggccaggtgcggtggctcatgcctgtaatcccagcactttgggaggccaaggcaggtggatcacctgaggtcaggagttcgagactagcctggccaacatgttgaaaccccatctctactaaaaaatacaaaaattagccagtcgtggtggcacgtctgtaatcctagctacttggaaggctgaggaaggagaatcgcttgaatctgggaggcggagtttgcagtgagccaagatagcaccactgcactgcagcctgagtgacagagctagactgtgtctcaaaaaaaaaaaaaaagaaaagaagtttaatggacttatagttccacatagctggggaggcctcacaatcacggcagaaggcaaggaggagcaagtcacgtcttacataaatggccgcaggcagaaaaagagcttgtgcagggaaactcccgtttttaaaaccatcagatctcgtgagactcattcactatcaaaagaacagtgcagtaaagacctgcccccataattcagtcacctcccaccaggttcttcccataacatgtgggaattgtgggagttacaattctagatgagatttgggtagggacgcagtgaaaccatatcagtcaggcatggtggcatgcacctgtaatcacaactactcaggaggctgaggtgggaggatcaattgagcctgggaggtcgaggctgcagcgagttgtgattgtgctactgcactccagcctgggtgacagcgagaccctggtcttggggaaaaaaaacaagaagacttagaaagctacagtgatgaaaacagtgtcatactggcacacgcatacagagatcaatgacacagaatatacagtagttcagaaatagctacttacagttacttagtagtaaaaagatgactggcaggatgtatttgtgccatatatgatagacaaaatgttaattgcctggatacatataaagcacctacaaatcaatttcagaaagaccaacaatccaatagaaaagtgagccagagacatgagcagctagttcatagcagaggaaacatgcatgacttcatctaggcagagatgctcaagctcactcgtaaaagagaagcaaattaatgtggtagtgaaatgccactttttcgtctctcagattagcaaagctaaaaaaaaaatcctgaaacttctactggtgagggtgtaaggaaactcagacatgacaggtagtggggcataaattaaacttctttggagggtaatatatctgtatttaaattgtaaatattctttgttccatttctactaatttctttcttttcttttctttcttttttttttctttttttttttcttttttttttttttttgagacgtagtctcactctatcacccaggctggagttcagtggcacgatctcagctcttggctcactgcaacctctgtctcccagattcaagcaatctcctgcctcaccttctggagtagctgggattacaggcactgcgaccattcctggctaattgtgtgtgtgtgtgtgtgtgtgtgtgtgtgtgtgtgtgtgtgtgtgtgtgtgtgtttagtagagatggggtttcaccatgttggccaggctggtctcgaactcctcacctcaagtgatctacccgcctcagcttcccccccagagtgctgagattacaggcacgagtcatggtgccagcctcatttctattaatttcttaagcaaatcaagagcatacattgtggcattgtttgtagtggcaaaagattggaaacaacctaaatgtccatcataggaaattcatgaaataaaactacctcatgtatccagaggaataccatgaaactgttgaagagaatggggacatagtccttgtgtgctgtgacaaaacgatctccacacacagtattaagggaaaaaaagtacctggcacggtggctcatgcctgtaatcccagaactttgggaggccgaggtgggcggatcacctaaggtcaggagttcgagaccagcttgaccaatatgatgaaaccccatctctactaaaaatacaaaaattaaccaagtgtggtggcatgcgcctgtaatcccagccacttgggaggctgagacaggagaatcgctagaacctgggaggtggaagttgcagtgagcccacatggtgccagcctgggcaacaagagtgaaaccccatctaaaaaaaaaaagcaaggcgccattgggaaggggaagtggggcctgcatggctgaattcagagaaggaagggagtcttggttatcagattatctctgcagctgatctccaaacctatttcccttcttcctggcacaggggccactcatttcccagactcttttgcatggaggcatggttgtgtgattgaaatccagccaggcgagcaggctcagcccacagaaacctcccatgggccacccccatgccttttcttcctctggtttgtgtggaatggtgctgagcccccagggcgactttggtggaatctggtgttgaaatcagagtcccaccgccgggcgcggtggctcacgcctgtaatcccagcactttgggaggccgaggcaggcggatcatgaggtgaggagatcgagaccatcctggctaacacggtgaaaccccgtctctactgaaaatacaaaaaattagccgggcgtggtggcaggcgcctgtggtcccagctactccggaggcggaggcaggagactggtgtgaacccgggaggcagagcttgcagtgagccgagatcgtgccactgcactccagcctaggcgacacagtgagactccgtctcaaaaaaaaaaaaaaaaaaaagaataagcaaatcatgcaaatcatcctgttctaaactctgaaccgctgcttccaagaccgtccctgcccttgccctggccgcctctctccttgttaactgggctccattcattctttccatttctctaacacgtgccaggtggtctcatctcctggcctttgcccttgctgttccctgtcatcattcaggtctcacttgtcatttcctgaccatggtacttataaaagcagtgccgtctgccccatccatgtcacctcgttcatctccttcacctccgaaatgatctcgcttttgggtttacggccggtctcttcacctggagcatcagccgggaaggtcagggtcgccctggctcgggcctgttcacattggggtcaaaggcacacattgggggctcaaccaaggcgagctgcgttcgcggggccgggtctttccgcacaggcggagggcggtggcgggcgcggaggcgtcgcgcgagccagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcactttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccattggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatataagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttactgggtaactctttgtccatctcaataaccaaaggaaggtgggcatggtggctcacgcctgtaatcccagcactttgggaagccgaggcgggtggatcactcgaggtcaggagtttgagaccagcctggccaacgtagtgaaaccctgtctctcactaaaaatacacaaattaggcagtcatggtggctggcacctgtaatcccagctacttgggaggctgaggcaggaaaattggttgaacctgggaggtggaggttgcagtgagtggagatcatgccactgcactccagcctgggagtcagagcgagactccatctcaaaaaaagtaaataaatgaaatagcctaaggaaatgctggcaggcagtaatgatatggcacactggatatgatttctgcccctcctctgctgtgggtaaacagcttctgtttcatgcatttacttttttattttaattacaccaataagaatgtgcttgaatgtttcatgcatttaatttgtttcatgcatttaacttctggcctgtttacctgtagcaggctctgagatgtgctctagagacagaacctaaacatgatgcccaagagaggggagagatactgaatgtccaatgttctcaaattttttttttttttttttttgagacagggtcttgctctgccatccaggctggagtgcagtggcacgatcatagctcactgctgcctcgacctcctgggctcaaatgatcctcctgcttcagcttcctgggctaatgtttgtattttttgtggagatgggactttgttatgttgcccaggctgttttcaaactcctggactcaagtgatcctcccgccttagcctcctaaggtgctgggattacaggtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatacaaaaaaaaaaaaaaaaactagccgggcatggtggctcatgcctgtaatcccagctactcaggaggctgaggcaggagaattgcttgaacctgggaggcagaggttgcagtgagccaagattgctccattgtactccagcctgggcaacaagagagaaactccgtctcaaaatataaataaataagaaaaagaagaaatggaagctgggttcaagagggcaatcagcagtctctaccatcatgtgaaacaccactctgtgatttgagtcttgacaatgtattttctttttttttttcttcttttttttttgagactgagtctcggtctgtcgcccaggctggagtgcagtgacgtgatcttggctcactgcaacctctgcctcctgggttggagcaattctcctgcctcagcctcctgagtagctgggattacaggtgtgcgccaccatgcctggctaatttttgtatttttagtagagacggggttttgccatgttggccaggctggtgttgaaggcctgacctcaggtaatccacccacctctgcctcccagagtactgggattacaagtgtgagccaccgtgcccggccaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggcagggtaaagagtgtgagtcatctccaatgacaggtaaggtcacgtgggtcacgtgtccactggacagggggcccttccctgcctggcagccaaggcagagatagacagggagagagagagacagcttacgccattatttctgcgtatcagagacttttagtactttcactaattttgctactgttatctaaaaggcagagccaggtgtacaggatggaacatgaaggcagactaggagcgtgaccactgaagcacagcaccacagggagacggttaggcctccggataactaatgattaatgatattcatatataatcatgtctgtgatctagatctagtataactcttgttgttttatatattttattatactggaacagctcgtgccctcggtctcttgcctcagcacctggatggcttgccgcccacagccaacaatgtgttttcaatatgctccccaaactacagcaaactcctcttaactcgggatttagggtgatgccctacttatgcctaactttatcaccagcttaaccctcatctcattatataggatgatattacttctaggaagattttctatgtatggagggtgcatcatttaagagtattttaggccaggcactgtggctcatgcctgtaatcccagcattttgggaagctgaggtgggtgatttgcttcagcccacgagttcaagatcagcctggccaatatggtgaaaccccatctctacaaaaaaatacaaaaattagctgagcgtggtgatgtgtgcctgtggtcccagttactctggaggctgatgtgggaggatcacttgagcccaggaggtcaaggctgcagtgagctgtgattgcaccacttcactccagcccagagtgagaccccatctctgaaaaaaacacaaaaaacaagaaaagaatactgcaaagaaccttggtaggggtgaattggaaaaagtagagaaatgtaatatttctttcctgctgtactcactgtaactgtgagaggatcggctcttttaaccaacagataagaaaggaaatattagctatgaagaaatgtctatcaagttgattttgacaacctagacacattaatctccttgcacttttagtgacaggaacccattagaaccttaagcagctgtctgaagtaaaaacaaagctctcaggtgatgaaccacctaatctccctgggtattcggatgtgggtcagtcacaggagtattaggtgtaaagccgctgcttctgggtagagcctccacttgtggctgcacagagggcacagagagcttttccttcagcccggagaagcttcctaagtgtgggcgccaccttgtgggacatacattgaactacgacgctatttctccaagaattaacaggacagcccctcccaccggtgtccttccaacgatgttgcatacaatttggctgtacatttggcaggcagtgtaatgagggaatcaaagaccaggatcacatactggaaagaattgaaaacagagactcccaacaaaaacttgtacacggacgttcacagcagcactattcacgacagctcagagatggaatcaacccaaatatcagtcaatagatgaatggacagacaaaatgtgacatatccatgcagtggaatattatttagccataaaaaggaaggaagtgctgatgcatgttgcgatgtggatgaaccttgaaaacatgatgctgagtgaaagaagccagacacaaaaggagaaggactgtatgatttcacttataggaaatatccagaacaggcaaatctatatagagagaaggtcgattgctgggggccctgggaagggaccaagggggagtgacttctaatggtggggtgcccttttggggtgatgaaaatgttttggaaccagatacaggtggtggttgtacaacattgtgaatttactaaatgcaaccaaattgctcacttaaaaacaacaaattcaggccaggtgcagtggctcacacccgtaatcccagcactttgggaggccgaggtgggcggatcacatgaggtcaagagttcgagactagcctggccaacatggtgaaatcccatctcggccgggcgcggtggctcacgcctgtaatcccagcactttgggaggctgaggcgggtggatcacgaggtcaggagatcgagaccatcctggctaacacggtgaaaccccgtctctactaaaaatacaaaaaattagccaggcgtggtggtgggcgcctgtagtcccagctgatcgggaggctaaggcaggagaatggtgtgaacccaggaggcggagcttgcagtgagccgagatcgcgccactgcactctatcctgggtgacagagtgagactctgtctccaaaaaaaaaaaaagaaaccccatctctacccaaaatacaaaaattagctgggcatggtggctggcacctgtaatcccagctactcaggaggctgaggcaggagaattggttgaacctgggaggcagaggttgcagtgagctaagatcgcaccactgcactccagcctgggtgacagaacgagactgtctcaaaaaaaaaaaaaaaaaaaagtggccaggtggtgccatggctcatgcctgtaatctcagcattttgggatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcaaaaggaaatagatgcagatggtatagaaagtttcagtgaaatgtaaatctgatgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgcagcctctacctcctaggctcaggtgattcttctgcctcagcctcccaaatagctggtactacaagcatgtgccaccacagtcagctaattatttttggagagtcagggtttcactatgtagctcaggctggtcttcagctcctggcttgaagtgatcctcctgccttggcacatagaaggggttacaatatacatatattagagtgagagcatagatgtgatgcctggcgatatggcttacttatgagacagcacctgacctacagccatctatgactcctactgtatcttccatgccaggagtaagggtgaggatacctggcaataataaaaataataacctgagagtctaatggcttattttttgtagagatggggtctcactgtgttgtttaggctggtcttgaacttctgggctcaagtgatcctcccacctcagcctcctgagtagctgggattataggcgtgcactaccatgcatatatatatatatttttttttttttttgagagagagagagagagatggagtcttgctatgttgctcaggctggtctcgaactcctggcctcaagtcatcctgctggcttggcctctcaagtgctaggattacaggcatgagacactgggcacagccctaatagcttatttttaaagctatatcaaaatgtcatgcacctgaacatttgaagtaacctctctgatagtacggatatttatcccctcaaaatctcatgttaaaatgtaatcttcagtgttggaggtggggcaaggtgtgaggtgttaggatcatgggggtggatccctcatgaatggcttggtgtcctcccccatggtaatgagttcactcaagagctggttgtttaaaaggtgacgtggacctaatccctgttggactgaacaaaaggggacgaacacagcaataaagataaagaccaaagagtatatttggaagaaggggtcagggggctccttgcttctagtgaaaaagggccctgagctttagtgccctttgtatttattgggtaaaggagatagggagaagggggggtggttgtcggtcagcagcttgattcacagcaggctcacaagattgcattctttgaacagtaggctctagatgtctcagtagataacctcaaagagcatggcgccagggagtgattgccctcagcgaaccttctggcggctgaagcagaagtgagtttgcccacattctgcatttatgataaacagtttgctgtttgatcatatagcctcagtggaatgctgagttggtcacaacccatgggcattcagctctctacatttccccctttctgtttatgaattaattgaaagaatgtaaggccaggctgggcagctctcattttctgattggcagtccatccaattttacagactatgaacagaagacagagacaaaacaacattattccaaggactacatataagatgttaatgtggtgctttagacaggtccaagggttgaggctctccaggccttgctggaatttggtctagtcttctaaagaaggctgaaactcttgagtttgtttatttaaatcaagaattttgttttgtaattcaccgatatcaaaggtgatgttggatgtgcaagctccctgcaaatgggctttcacaaggtcccatggatactcactttggttatattctaagttggttacacaaatatgagtgtgattaaaatgatggtgcaattgctgttgcaattgcaagctttgtacttgttctcctaactgtagagccgtggatttcaacaatgccacttcagtttgtaactcagtgttaattttattctgaagtggccatgcttggttggctatacgcatccagttttccatgtactgagttgtttgaatagaactatgcaaagctacagaggacatcacaacggaagttattaatgtgaccaaggaaacaatagcaaaaattatcatgcctaaggctctatgggcacaatgagtaagttgagttagaagatgtttcatgaagtgcaaagcaggtgtggtagcccaaggctgggacagattaacaggaatccatagcccagggatgcgacccaaaattatcaaagtagagacattatgtgtttgcaatgtgctatgattaatgcagtgacataactggcaagatttacaggtcaattggatattgtttacctggagctggtccttcttagttgccaaaaaagacataaggattaaaaagacaaaccataaattgagtggtgatattctttacaaatgtaacattaagactgtgttgcttactattgctatcactggatagtatcccgccattcataaatgggagtgctgccttccataacatctcttggattggtcctttcctccctagataatgccactgaggaagaggcgggctaaagcctgctccatgtcaagcaatctgggtggcagactgggattagatcccggtgtggtataaagaagaagcattaaaatcttgccaccaatgccagcgaagtttgtgccatgatttctgattttcatgttttccatatagttgacctttaggtccccaatccacaatgtctccagttaacatagattgttttctagccagtgggtcaagacattgggtccatgtcttggggggtagtaactatcgaagggaatccattccatatagtcagcacgattagggtgattgggccgggaatggttggttagcacacctgttacattaatagaaccaagacttaataggcacatgacttttccataatgactcaaccattcttgagcttgaattataagacagctacagttaagcgatgtctttgtagtgatacacaaggggagtccttctagtggggtggtataattaatgacattgttctgagagtctaactgttctattttaaggggagttaggggtcctggagcccatacttgctgatcacgataaatctcaggaggagtgtcactccaaagcataggttgtactactaggggattgggaacatatgcccaaaatgtttttgcctctgcacagggaaaacataccacacaggacattatggctaacatggccaagaacatggaatcagggtgttttgcctggctctgatgctccagtagtttcccagcttcctgagtggtattcttgagttgcccccaggttatgggggttgatgtcgtcatgactccggtcggccttctctccatctttgcactctggctcagctggctcatggctcataccagagggaccaggcccatagttggccaccctgggttcctctagtctcccgttccatggtcacatgcaccttgagggcacccacacggcttgtccatctcccataaaaacacaagcataccctcatccccacgtcagtaaatccaacagacctttccattgtcttttttccgggggatttcaataacactttcggataaactttcctcttttcctctaacacttgccaatgtctttctgctggagtcttaccatctgtaccaggagtcaaaaaaatttaaagaaaataaggctaagtgtagttttgtttgaggtgtaactggtctcctatccctcttttctgtttttccctttttttttttttttttttttttttttttttgagacagagtcttgctctgtcaccaggctggagtgcaatggcacgatcttggctcactgcaacctccacctcctgggttcaagtgattttcctgcctcagcctcccaagtagctgggactataggtgcgcgtcaccacgcccagctaatttttgtgtttttagtagagacggggtttcaccatgttggctagatggtctcgatctcttgacttcatgatctgcccacctcggcctcccaaaatgctgggattacaggcatgagccaccgcacctggcccctttctgttttttcaacacgtgttgtaatgtttgatgtgccaactctataattccttgtcctctaggattataataattccttttttatgggttatagctcaaagctgtaagaattttgaaaagcatgactagtataagctggtccattgtcaggttttaattgtttagttatccccatatgagcaaatgatgacaaacaatgttgccgtacatgaccagctgtctcacctgtttggcatgtagcatgcagcatatgagaataagtgtctataattagtgaacatagctaagtttactaaaggctgctacatgtgtaacatccatttgccagatttcatttggagccaaacctcatgggttacaaccttctacaggtgtggctccagggacatgctggcaagtaggacaggcttgtattatagccctagcttggctgcgagagaaatggaacatgcgagtagggcagaagtactttggtgcagaggcttgagcttgctgaaacacagaactaatcagtttatctgctctatcattacctagagatagtggtccaggaagttgtgtgtgagagcgaatatgagaaatatgaaaaggagatgaaggagagccaatagttgtttgaagtcttagaaacaaattaagcagttctgggtctagtgtatttttaattgtagcagtttctatgcaactggctacatttacaacataagttgaattacagacaatgttgataggatctgcagctgtcagctgtaaaacctgaatgactgcaattaagtctgagcgctgagctgaaaccccagaggtcattattgtttgagtatgtttaggtccataaatagctgcatgagctttagaagagccatcagtaaaataagtctggccacctgaaataggcttgtgatgagtaatcacaggaagaatgaaagaatggactttataaaactgcaaaactttgtctgagggatagtggttgtctatggcacccacaaagtctgcaaaagtgatttgccaggcagttgacatttcccaagctgtggactgttgctgagagtctaaaggaacaataattttatctggatcatatcccataggcatctttgacctatgcctgcccatagtcacaatttgtgtaattaaagaaagatagacttgcaaagttttgactgattaggtagaaagagccattctattacggttacagatttgtctaagcattggcctaaaagtcctgttggagagtgagggataggaagaacaaacaaaagcaaaggtttttgtggctgtagccatgaggcatgtcattgctgtagcatctgctctacaagttgtaactccacttctgcctctttggtcaattgctgtggggaatttaaggaagaatctccttgcagggtttgataaagatgtgtaagttgataagttgcaatacctagcattggtcacagccaatttatatctcctaataattattgaaaatcatttaaagtctgtaacctgcctttatggagaactactttctgaggccgtacactattggggaacctgccccgatattcatgtaggttcttttctatttttcctaagcattggccagcttgagaaataaagggacagagtacaaaagagagaaattttaaagctgggcatccgggggagacatcacatgtcggtaggttccgtgatgccccacaagccgcagaaaccagcaagtttttattagggagtttcaaaaggggagggagtgtgcgaataggtgtgggtgacagacatcaagtacttaacagggtaatagaatatcacaaggtgagtggaggcagggtgagatcacatgaccacaggaccaaggcgaaattaaaattgctaatgaagtttcgggcaccattgtcattgataacatcttatcaggagacagggttttgagatcaaccttctgaccaaaatttattaggcgggaatttcctcttcctaagaagcctgggagcactatgggagactggaatctatttcatctctgcagcctcaaccataagagacaggtgcacctgggggggctgtttataagcctatacctccaggtgcgtattctctttctcagggatgttccatgctgagaaaaagaattcagtgatatttctcccatttgcttttgaaagaagagaaatatggctctgttctgcccagctcaccagcggtcagagtttaagattatctctcttgttccctgaacaattgctgttatcctgttcttttttcaaggtgcccacatttcatattgctcaaacacacatgctgtacaatttgtgcagttaatgcaattatcacatggtcctgaagtgacatacatcctcctcagtggacaggattaagagattaaagtaaagacaggcataggaaagcacaaaggtattgactggggaagtgataagtgtccatgaaatctttacaacttatgtttagagattgcagtaaagacaggcataagaaattacaaaagtattaatttggggaactaataaatgtccataaaatcttcacaatccacattcttctgccatggcttcagccagtccctctgtttggggtccctgacttcctgcaacagtacactcccctccataacaatagttcctaagtattagtatggggaagttgtttgcactttctctggagcaattttgagattccatttaattaaagcctgttttgtttctctgaataactgatgtaaaatttgatctgtaggagcggccaaaagaatatcatccataaaatgaatgatatacacagtgggaaacatatttcaaggctcctttaatgctcttcccacaaaatgctgacataatgtaggactgttaagcatgccttgaggtaaaactttccattgatagtgagaaacaggttctctatgattaatagaagacacagagaaggcaaattgaggcttatccttctcgtgttatggtatagtaaagaaacaatccttaagatctattcctacaagaggcctgtctcttggaatggctgctggggaaggtaaaccttgctgtaaggcacccattggtttaatttgcgcattaataactctcaaatcatgcagtagtcaccatcttccagacttttttggaataacaaataccggtgaattccaggggctgacttctctatatgtcctgcattcaattgttcttttaccaacagatgaagttgatctagcttctcctgtgttaggggccattgatccacccacataggtttgtcacaaagccattctaatggtaaggcagtgggtcgaggagaaatatcaatgatccccatcagaaatcctgacatccttgcccttttctgtttctccagttatagatatcgggttagggtttccttgtaggaatttccctaaaccttttccactctgatatcccatgtccttcaacattttaaatcctgggttatgaaagttttcatttgtaagtctcatatcccatgctgtaagtaattcttgaccccataaattgatagctatatttgcatcataaggctggaaagtacatgattgtccatccggaccaagacaaggtaaaatctcagcactctgttgaacacttttagctgctcctactcccactagggatgtggaggttagtctgagaggccatgctgggggccagtccttactggatattactgacacatcagctcctgtgtccataagcccatacaatttctttcctttactttgtactacacaggtgggtctattataagctataggttgtgaacatagatttctcatgtagttgtgctcccaaaccctttatttcctcgtttctccttttatggagaagggtgtaatttgcagggaataagcaataattgagcaatatattcttccggttcaaaaacccaaagatcttgtgacattaaaactacttgaatttctccttcataatcagagtcagctactcctgggactacagtaatgccttgcaagttaaggcagcttttgcctaaaattagtctatgtatcctgctggtaaaggtccccaaatgccaatgggaactttgataggtttgtctccaccaattaatgtaattctttctctgactggaagatctaatcctgcacttcctggtgttcctggggtgagggaatcaatgttcctcctgggacccacccctgaagtggggttgtggtctgaactgggaatgccctcattgtttgaggggcccgggtccaggcccccttctcgtttcctgacaggtggttgcagttttgatgaaattttgagcggcattgaatagcccagtgatttcctttgttacagtgaggacagagtcctggcgtttttttccgctgggccaggggggtggagggcaccacattataaggtcctttctgccctgagatcaggcagcattcctttttaaaatgtccagtttttccacaattataacattttcccactttagggtttgaccgttggctccttttagatttgtcaactactaaattagccattgcttgagctaaaattgcagagcaatgaagctcagtttctacatcctgacaagttctgagaaaatttcccaagttttgtacacctcacaggtgccagtgcacgtttacaatctgcgtttgcattctcaaaagctaaagttaaggttagcatttctgtggcagcggtatgaggaatttgatgcttcactgcctcttgtaatcttgcaagaaattgcacatagggttcctgtgacccttgcatgagatgtaaaaaggattgtactgggactctctcttctggaattgtggcccaggcgtgtttagcagcctgtgcacactgctgataagcaggatctgggagtgccatttgacattccaggtctgaataaagggccattacctaacagcataccctctgtaatgtctccgtgtccagaagcatgattctgtctagcctggtctgcacacatttcttgccaatttaaattccaagtcaggtatgcagtagcagacaaacaagtgcaagccaaatgttttacatcaaagggtagaaggcgcatagcaccaaatacagattctagcaatcctaaggtgaatgggctctgtatcccattattaattacacttaatttttcattccttcaacaacgtaaactctagtggggtgtgttcatgaataaactgctgtggattgtttggatcaggccttatggaaataggaaaagtgcaggcagcagagcataaaattctttgtattgaggtctctatttcggctactgaaggaggcggtacagatgtttctgcaactggagggggcggtataggccaatttttatcctccctctcctgttttttattttcaattggtgctgtgggtgggacaacagattctttcagatttttagactcagaacatgactcctgctgtccagcagaataaaaaggatataatggcagaaggacagtatgaactaaactcctagtggagaaagcagaagaatcaactttaagacctttttgatgagcctgttttaatccttctcctgctctgtgccaattttctacatcaggagtgcctgcctgtggaaaccatgggttatgcgtaataacctcctgcagcatcttagttaatgtctgagaattaacctgagcaccagattgtttcaacaaaactttaagcaactgcacgttttttttttcaacagacaaattctgccccatgttacctgattcagaaaaattcccattcccagtacttctttttttttttttttttttttgagatggtgtctcgctctgtcacccaggctggagtgcagtggtgcgatctcggctcactgcaagctccacctcccaggttcacaccattctcctgcctcagcctcccgagtagctgggactacaggcgcccgccaccacgcccagctatttttttgtattttttagtaaagacggggtttcaccgtgttagccaggatggtctcgatctcctgacctcgtgatctgcccacctcggcctcccaaagtgctgggacccagtacttctttaagagagcactgaccttatattgctcccagtacctcgttagggcactgaccttatatctgctgccagtggactcatcccagtgtccccattcgtcttgtcaatttcagcttctctgcttcagcagaccttcttcgttcatgtcctcagagtccctgttctggggtgccactttgatgcgtgaatggaccttggtggactgaacaaagggggacgaatgcgagaataaagataaagacaaaaaagcatatttggaagacatggtcgggggctccttgcttctagtgaacaagggccctgagctttagagccctttgtatttattgggtaaaggagatagggagaagggtggggggtggttggtggtcagcagcttgatttacagcaggcttgcaagactgcattatttgaacagtaggctctggatgtcccagtagataacctcaaggcatacagtgccggggagtgattgccctcagcaaaccttctggtggctggagcagaagcaagtttgctcacattctgcattcatgataaacagtttgctgtttgatcatatagcctcagtggaatgctgagttggtcacgacccacgggcattcagctctctatgaaaaggagcctggcatctctcttgctccctcctgccatcggatatgccagctccccctttgccttctgacaggctttctaagcttcctgaggcttcaccggaaacagaacagatgctagtgctgtgcttgtacagcctgcagaaccatgagccaaatcaatctcgtttctttataaattactctgcttcacagctgggcatggtggctcacatctgtaatcccagcactttgggaggccgaggtaggtggattactgaggtcaagagttcgagaccagcctgaccaacatggtgtaaccccatctctaataaaaatacaaaaattagccaggcatggtagggcatgcctgtaatcccagctacccaggaggctgaggcatgagaattgcttgaacccaggaagcagaggttgcagtgggccaagatcgtgccactgcattccagcctaggcaacagagccagaccctgtctcaaaaaaataaaaataaaaaattacccagcttcaggtattcttttatagcaatgcaaaacagactaacacactgtctttttttctcagctgtaaagtgagaataatcattgtgaaatgagatattaaaattctttggaatcatgcctcctcagcagctttacaaggctaccatgtggagttgttcagtgggtatagagtttcagttttgcaacatgaaaaagttcttgagactggctgcacaacagtgtggatatacttaacgttactgaattgtactcttagaaatcgttaggatgaagctgggcacggtggcttatgcctgtaatcccagtactttgggaggcagaggagggtggatcatctgaggtcaggagtttgagaccagcctggtcaacatggtgaaatcccgtctctactaaaaatacaaaaaattacttgggcatggtggtgggtgcctgtaatcccagctactcaggaggctgaggcaggagaatcgcttgaacccaggaggcggaggttgcagtgagccgagattgcaccattgcacgccagcctaggtgacagagcaagactccatctcaaagaaaaaagaaatggttaggctggtacattttatgctatgcattgtttctcagaataacaaaatttttaaggaaatgaccaccacgtgagatacctaaaaagctgtcccaggagagggatgatatttattctgtgagctctgagaggggagacaggagccagttagcaaccactgagtactccagccggcccacaaagccccagcatggatgctgcacctgagtgaggctggccttggagacctctgggccccttccagctcagaggtctgaaggatttgagctgagtcaggtcagcagatgctagaactttccattcacagactgtccagttttgctatatttgaggaacagaaacaggtcagaaagcagggcatgctctcatactactaggaaaacataatgtgatgcaacctttattattatcatttatagtattatttttaaattttgttatttatttattattttatttatttttttttgagatggattttccctcttgttgccccagctggagtgcacttgcacaatctcggctcactgcaacctctgcctcccagtttcaaatgattctcctgcctcagcctcctgagtagctgggactacaggcgtgtaccaccatgcccagctaatttttgtatttttagtagagaccgggtttctgcatgttggccaggctggtctcaaactcctgacctcaggtgatccgcccgcctcagcctcccaaagtgctgggattacaagtgtgagccaccgtgcccaatctttttatttattttattgagataaggtcttgctgtgttactcaggctggtcttgaactcctggccttccagagtgccaagattacaggtgtgagccaaggtgcccagaaggcacaacctttctggcaggcattcacaactaagaacttaatccaagagcacaattggccaagcgtgtgacgttagagaagagcactgttgttgtgaacttcaaccaatgaagatggcctgagaaaaacctgtgacagcttggcagaattcagaaggatgagacatcactccaactgagccacgaaaatatggtctggaggcagggaacataagcccaattcacacttcagctatgacagaaaatatcctctccatttacatagggcgtacaccgagtaaatgactttgtaactttacttcattctcttcttttacatagggtgtacactgagtaaatgaccttgtaactttacttcatcctctttatttacatatggcgtacaccaagtaaatgactttgtagctctacttcatcctcttcatttatgtaggacatataccaaggaactgatggaaacttctagagggtatttaaaccccaaaacattctgtaatggggcccttgagcccctatgctcagcctgctaccacactgtggagtatactttcattttcaataattttcttcatttctttccttgctttgtgcgttttgtccaattttttgttcaagacaccaagaacctggacaccctccaccggtgacacaaccatcaggcaataggggtacacctgggaaggacaagggacagttagtgcagtgaggaatgggaggcagggccgagtctctctgagctgggaggctgctccttctggcctctccaaagcctcactgcttccatttcccgaggcagataaggactgcctcagcctgggacaaaacgacctctctgtgtccacagccacccacaattggcataatgttccagtctcacttcccaggagcctctgaagggcccagcttgggtcagatggccattcctgggccagtcagctatggccaggggatggggtcacatggcacccacatgaagcaaggcctatcccttaagtaggggctgttgagtgacaggaaccgtggaggtgttgacagccgctcctcaaagtatggtcctagactgagcagcagcacttacatcactcggcagcttcttagcaatacagaatctcaggccccaccccacacctaaggaatcagaatctgcttatttatttatttattttgatgataggtgcatgccaccacacttggctaatttttgtatttttagtggagtcagggtttctccatgttggccaagctgatctcaaactcctgacctcaagtgatccacccgcctcagcctgccaaagtgctggaattacaggcgtgagccaccgcacccagcctgtagcccacatattgatcctgtctgttctttttttctttttattattattattattattatactttaagttttagggtacatgtgcacaatgtgcaggttagttacatatgtatacatgtgccatgctggtgtgctgcacccattaactcatcatttagcatcaggtatatctcctaatgctatccctcccccctcccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacttgtgcatgtgtctttatagcagcatgatttatagtcctttgcgtatatacccagtaatgggatggctgggtcaaatggtatttctagttctagatccctgaggaatcgccacactgacttccacaatgcttgaactagtttacagtcccatcaacagtgtaaacatgttcctgtttctccacatcctctccagcacctgttgtttcctgactttttaatgattgacattttaactggtgtgagatggtatctcgttgtggttttgatttgcatttctctgatggccagtgatgatgagcattttttcatgtgtctgttggctgcataaatgtcttcttttgagaagtgtctgttcatatcctttgcccactttttgatgggattgtttgtttttttcttgtaaatttgtttgagttcattgtagattctggatattagtcttttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaacccatcatgaattaatttttgtataaggtgtaaggaagggatccagtttcagctttctacatatggctagccagttttcccagcaccatttattaaataggaaatcctttccccattgcttgtttttctcaggtttgtcaaagatcagatagttgtagatctgtggcattatttctgagagctttgtcctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaattttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcattgagcagtggtttgtagttctctttgaagaggtccttcacatcccttgtaagttggattcctaagtattttattctctttgaagcaattgtgaatgggagttcactcatgatttggctctctgtttgtctgttactggtgtataacaatgcttgtgatttttgtacattgattttgtatcttgagactttgctgaacttgcttatcagcttaaggagattttgggctgagacaatggggttttctagatatacaatcatgtcgtctgcaaacagggacaatttgacttcctcttttcctaattgaataccctttatttccttctcctgcctaattgccttggccagaacttccaacactatgttgaataggagtggtgagagagggcatccctgtcttttgccagttttcaaggggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttagttctgtttatctgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcacaaaatgagttagggaggattccctctttttctattgattggaatagtttcagaaggaatggtattagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcttgctttctctcgtgggcatttagtgctataaatttccctctacacactgctttgaatgtgtcccagagattctggtatgttgtgtctttgttcttgttggtttcaaagaacatttttatttctgccttcatttcgttatgtactcagtagtcattcaggagcaggttgttcagtttccatgtagttgagcggttttgagtgagtttcttaatcctgaattctagtttgattgcactgtggtctgagagacagtttgttataatttctgttcttttacatttgctgaggggagctttacttccaactatatggtcaattttggaataggtgtggcgtggtgctgaaaaaaatgtatattctgttgatttggggtggagagttctgtagatgtctattaggtccgcttggtgcagagctgagttcaattcctgggtatccttgttaactttctgtcttgttgatctgtctaatgttgacagtgggtgttaaagtctcccattattattgcttgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgtttggtagatctttctccatccttttattttgaccctatatgtgtctctgcacatgagatgggtttcctgaatacagcacactgatgggtcttgactctttatcaaacttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtacaagtttttcctttccatgtttagtgcttccttcgggagctcttttagggcaggcctggtggtgatgaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcaatttcaggtacaccaatcagacgcagatttggtcttttcacatagtcccatatttcttggaggctttgttcatttctttttattcttttttctctaaacttcccttctcgcttcgtttcattcatttcatcttccatcactgataccctttcttccagttgatcacatcggctcctgaggcttctgcattcttcacgtagttctcaagccttggctttcagctccatcagctcctttaagcacttctctttattggttattctagttatacattcgtccaaaattttttcaaagttttcaacttctttgcctttggtttgaatttcctcctgtagctcggagtagtttgatcatctgaagccttcttctctcaactcgtcaaagtcattctccatccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtatggatgtcctttctgtttgttagttttccttctaacagacaggaccctcagctgcaggtctgttggagtttgctagaggtccactccagaccctgtttgcctgggtatcagcagcggtgtctgcagaaccgtggattttcgtgatccgtgaatgctgttgtctgatcgttcctctggaagttttgtctcagaggagtacccggccgtgtgaggtgtcagtctgcccctactggggggtgcctcccagttaggctgcttgggggtcaggggtcagggacccacttgaggaggcagtctgccccttctcagatctccagctgcgtgctgggagaaccactgctctcctcaaagctgtcagacagggacatttaagtctgcagaggttactgctgtctttttgtctgtgccctgcccccagaggtggagcctaccgaggcaggcaggcctccttgagctgtggtgggctccacccagttcgagcttcctggctgctttgtttacctaagtaagcctgggcaatggcgggcacccctcccccagcctccctgctgccttgcagtttgatctcggactgctgtgctagcaatcagcgagactccttgggcataggaccctccgagccaggtgcggggtacaatctcctggtgcgccgtttcctaagcccgtcggaaaagcgcaatattcgggtgggagtggcccgattttccaggcgctgtctgtcacccctttccttgaccaggaaagggaactccctgaccccttgtgcttcctgagtgaggcaatgcctcaccctgcttcggctggcgcatggtgcactacacccactgtcctgcgcccactgtctggcactccctagtgagatgaacccagtatctcagatggaaatgcagaaatcactcgtcttctgcggtgctcatgctgggagctgtagaccggagctgttcctattcggccatcttggctcctcctccccatctgttctttttttcttgagacagagtcttgccctgtcacccaggctggagtgcaatggtgtgatctcagctcactgcaacctctgcctcccgggttcaagcaattctcctgcctcagcctcccgagtagctgggattacaggcacgcactactgagaggtgacagtgtgctggcagcccttgcagccctcgctcactcttggcgcctcctctgcctgggctctcactttggtggcacttgaggagcccttcagcccaccactgcactgtgggagcccctttctgggctggccaaagccggagctggctccctcagctttcagggaggtgtggagggagaggcgcgagcaggaacccgggctgcgcgcggggtttgcgggccagctggagttccaggtgggcgtgggcttggcagtccccacacttggagtggccggccagccctgccggccccggcaatgaggggcttagcacacgggccagtggctgcagagggtgtgttgggtcccccagcagtgccggcccaccagtgctgtactcgatttctcgccgggccttagctgcctcccgtcggggcagggctctggacctgcagccccccatgcctgaacctccccccactccctgggctcctgtgtggcccgagcctccccgacgagcaccaccccctgctccacggcacccagtcccatcaaccacccaagggctgaggtgtgcgggcgcacggcactggactggcaagcagctccacctgcggcccgggtgcaggatccactgggtgaagccagctgggctcctgactggtggggacttggagaacctttatgtctagctaggggattgtaaatacaccaattggcactctgtatctagctcaaggtttgtaaacacaccaatcagcaccctgtgtctagctcagggtttgtgaatgcaccaatcgacactctgtatctagctgctctggtggggacttggagaacctttgtgtggacactttgtatctagctaatctagtggagaggtggagaacctttgtgtctagctcagggattgtaaacgcaccaatcaacaccctgtcaaaacagaccaccactcagctctctgtaaaatggatcaatcagcaggatgtgggtggagccagataagagaataaaagcaggctgccggagccagcagtggcaacctgcttgggtccccttccacactgtggaagctttgttcttttgctctttgcaataaatcttgttgctgctcactctttgggtccacactgcctttatgagctgtaacactcaccgcgaaggtctgcagcttcactcctgaagccagagagaccacaaacccaccagaaggaagaaactcggaacacatccgaacatcagaaggaacaaactccggacacgccacctttaagaactgtaacactcaccgcgagggtccacagcttcattcttgaagtcagtgagaccaagaacccaccaattccggacacactaccatgcctgagtaatcgtatttttagtagagacggggtttcaccatattggccaggccagtcctgacctcgtgatccacccatcttggcctcccaaagtgctgggattacaggcgtgagccacggtgcccaaccttatttatttttaattttttaattttaaaaaattttttggagacagtcttgctctgtcgcccagactggagtgcagtggtgtgatcttggctcactgcaacctctgcttcccgggttcaagcgattctcctgcctcagcctcctgagtagctgggattacaggcaggcgccatcacgcccggctaatttttgtacttttagtagagatggggtttcaccatattggtcagactagtcttaaactcctggcctcaagtgatccacccacctcggcctcccaaagtgctgggattacaggcgtgaaccactgtgcccggccaaatttagtactttaaaaaacatttaaaagtctgtttctgtgggtcgggagtttgggtatggcttggctgggtgcgcctggcatagtctctcacggggccacgatcaagttgtgggctggggatgccatcagctaaaggctcaatttggtgagtatcctttctaagctcatgtatgtgtgggtagtccttaggtactcactggcagctggtaagagatgttagttcctcgccatgtctgtaatggactgaatagtatattgccccaaaattcatgtttgcacagaagctcagaatgtgaccttatttggaaatagggtctttgcagatgtaattaagatgagatcgtgctggatgatgttgggccctaaatccaacgactgttttattaagaggagaggacacagagagacacacagggaaggccatgtgaagacagaggaagagcctggagtgatacagccaaagaatgccaaggactgtctggagccaccagaaggaaggagtcttccctgtagccttcagagggaacatggctttgttgacacttttttttttttttttttgagacagtctcacactgtcgcccaggctggagtgcagtggcgtgatcttgactcactgcaagctgtgcctctcgggttcacgccattctcctgcctcagcctcctgagtcgctgggactacaggagtccgccacccgacctggctatttttctgtatttttagtagagatggggggtttcaccgtgttagctgagacggtctagatctcctgacctcatgatctgcccaactcggcctcccaaagtgctgggattacaggcatgagccaccgtgccccaccacttttttttttgagatagagtctcgatctgttgcccagactggagttcacaggtgcggtctccgttcactgcaacctctctgcctcccgggttcaggtgattctcctggctcagcctccagagtagctgggattacaggtgcctgccaccaccactggctaatttttttatttttatttttagtagagacagggtttcaccatgttggccaggctggtctcgaactcctgacctcaagtgatctgcccgctttggcctcccaaagtgctgggagtacaggagtgagccacagtactcggcctctgctgacacattcattacagacttctagcatctggagctgtgaggataaacttctgttgttttaagccacccaatttgtgatactttgttacagcagccttaggaaccaagtgagctggcttccctaagagcagataagtaaaagagtcagagagggccccaatggaagccagagtttttctgctacctaatcttgaacatgacatctgttcactgaaagcaaaccacttgatccagaccacatgcagggcgagaggactacataagatcataaataccaagatgtgagcatcactggaggctgtgaaccagggctgccacaccagcaaaaaacagaggaatttcattggaagaaaccgctttcttcagggttctgccttctccattcattgattccttcgacaaataaatttattaagtacctacaatggactgggtattagggacatatgaccaataagacaaataagattctttcccttgttgagattatttagttacaggataataggaacatctgatttagattaggaaaggagggtatgggcaaggcatgcctttctgaaaaaacattatcaagaattggccaggtgtggtggctcacgcctgtaatcccagcactctaggaggctgacgtgggcggatcacctaaggtcaggagttcgagaccagcctggccaacatggtgaaaccctgtctctactaaaaatacaaaaattagccgggcgtggtggcgggtgcctgtaatcccagcaactcgggaggctgaggcagaagaatcacttgaactcaggaggcggcggttgcagtgagccgagatcgcaccactgcactccagcctgggggacacagtgagcctccgcctcaaagaagaataaagttgaagaatgagtagaaaccaggctgtgtgtgtatgtgtgtgtgttatgagggaagcatgagtttctaggtagtgggaaagcacgtgcaaataagtcggtaagttgaacagctagactaaaagctgcttgagagcagggaccttgtctcttcattgctgcatctctattatacgacatcatctctgcatctctattacaagacatagagcctggcagagagaaattcttactggatgaaatgaatgaataaatccaaggcatcttctataggttagtgcaaaaatgactgcagtttttgccattatttttaaatggcaaaaaccacaattacttttgcacgaatatttcctgttacagatgtcaactgaagtcatttaaaaattttctcccaaagttcatcgcgggatcattgctcttattcatattaggtagcataggcaaagctgctagaacaaaagactcaaagtaagtaaacggtcaacacaagtttatttattctcacataacaatactgagtggatatttaggtcagtaaggcacagttctcctccacttaggaatctcccatcttcaggccttgccttctccagagcctggtcaccatctgcttccagttggcagaaggagtaacagcacaggggagcacctgttggaggtctgtatgggccaggcctggaaactgcacacctcttctggtcactttccgctggggagagcataggcacagagccacacttaaattttactttgaggaatgcagtgtaggtgtatgtccgacaaagaaaacaataattcggtagacaaataagtctccactccaatattcaattacttacttaacttatgctctggtatgtctcaaattaacctagatagaaatgaactctgaatcttccacttccatcaagtttttcactcactcaatggcatcattatccatccagttgcttaagcatacatttgaaagttatccttggtctgtttcttatccttcccttccacatctaatccttcaggaagtcctgacaatgttacctccaaaatatgtcttaaatccatcttctcagccaggcacggtggctcacgcctgtaatcccagtactttgggaggccaagggaggtgaatcacttgaactcaggggttggagagcagccggggcaatgtggagagacccaatctctacaaaaaaaatacgaaaaattagccaggcatggtggcatgcgcctatagtcccagctactcaggatgctgaggtgggaggatcgcctgagcccaggaggtctaggttgcagtgagctgtgatcacgccactgcactctagacagtgggaccgtttaaaaaaaaaaatccatcttctctacacctttaccgccacctccttagttcagacagtgtaataatctctcatctgcattattctccaatagcctcctaatagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaagaccaggttttttgtctgtttgtttgtttttgagacggagtctcactctgtcgcccaggctggagtgcagtggcccgatcttggctcactgcaagttccgcctcctgggttcacgccattctcctgcctcagcctcccgagtagctgggattacaggcgcccacccaccacgccctgctaattttttcttttgtttgtatttttagtagagacggggtttcaccgtaatagccaggatgggctcgatctcctgacctcgtgatctgcccgccttggcctcccaaaatggtgggattacaggcgtgagccaccgtgcctggcccaaggaagacgaggttttaaatcataaagattctaaaagactgccttgacatatccttcttttgttttgggttttgtttttttttttgagtcggagtctggctttgtcatccaggctggagtgcagtgggatgctcttggctcactgcaacctccacctcccaggttcaagtgattctcctgcctcagcctccccagtagctgggactacaggcacgtgccaccacacccagctaatttttttgtatttttagtagaggtggggtttcactgtgttagccaggatggtctccatctcctgacgtcatgatttgcccgcctcggcctcccaaagttctgagataacaggtgtgagccaccgcgcccagccttggtttgggttttattggcacagaggcatgatatgccgcctgaagttatttaattgggttgtgaatcaaagcgtatgtggccagtttttaaacattgtctcctgtgtgccagatggtgtcctagacacaaatggtacaagccagactcctagatgtccctactgtcatgtagcttatattctagagggtggggttactgctaggtggttttaattaagtgtggaaagggtgaggagtactgtgttaaatagggtagtccgaggaggtgacactgtagagttctgatggaaatgcgagagcaagccaccactgtctcagggaagagtataacaggcagtgggaatagcaaggacagaccttgaggtagaagcaggtgtagtgtgatgtaggaagagcaaggtggctggaatgcagtgggtcagtggagatgatgtagagcagcaatgggaagcaaggcacttagggccttgtaggccatcgtaagaactttgggtttgaccctgattaaaaggggaactataggagagttttgaacagaagagagacatagttccaggagataagtatacaaatagggcagcaatgtcacttagtggttgttatagcttctctaggtagactcagttgaaatctcaccctatgtttttttttgatacagagtctcactctgtcacccaggctggagtgcagtggtgtgatctcggctcactgcagccgcctcctcccaggttcaagcaattcttgtgccttggccctccgagtagctgggactacaggcgcacaccaccacgcccggctatttttgttgttattgctattttgttgttattgttgttatattgctagaaaagatggggtttcaccatgttggccaggctggtctcgaactcctgacctcaggttatctgtccgccttggcctcccaaagtgttgggactacaggcatgagctaccacgcccagcccagcgtttctattttattagccgtgtgtctgagtacgacatcacttcacttctgtctcgttagtttcctcatctgtagatgggataaaagcactcccagcttatagggttttttgttggtttgtttgttagtttttgaggattaaatgagcagatatacccaaatgtgcttataataatacctaggccaggcacggtggctcacacctgtaatcccagcactttgggaagcctaggcgggcggatcacctgaggtcaggagttggagaccactctggccaacatggcgagacccccgtctctactaaaaatacaaaaattagccgagtgtggtggcacacatctgtaatcccagctactcagaaggctgaggcaggagaatcgcttgaacctggggggcagaggttgcagtgagctgagatcatgccactgcactccagcctgggcgacagagttagactccttctcaaaaaaataataatacctaacagcaagagctcaatgaatattagctcatagcaacttaagggtgctttagaaagagttgtttttttcacttgactcttgcccagcccaattttcttaaaatttttttagcttttcttcactcagaagtactcaataggtcatggtgaatctacgctaatttgggcatttccagccaatacctattggtggacttgaaaatcagtactgattaggatgtactgctttggaagcaagccagcattacatcaaataaaaaacatttggtctgtggcattgtgttgtattcattgttttgctttttggggggtgttcagcagatggtgagcactgagacaaacctgtagtgttcagctggaaagctattttcctggcctccagccacaacactttaactcttgctgccagactacctgagagtgggttgattggactttaagatctcatcctcccttatccacggttttgctttccacaattttagttacatatggtcaactgcagtctgaaaatattaagtggaaaattccagaaatcaataattcataagtttctttttctttttttttttttttgagacggtcttgctctgatgcccaggctggagtgcagtggcgtgatcttggctcactgcagcctctgcctcctgggttcaagcaattcttctgcctcagcctcccgagtagtagctgggattacaggtgtgcaccaccatgcctggctaatttttgtatttttagtagagacggggtttcaccatgttggccaggctgatctcgaactcctgacctcatgatccaccctcctcggcctcccaaagtgctagagttacaggtgtgagtcaccatgcctggctctcataagtttcaaattaagcactattctttgtagtgtaatgaaatctcttgccatattgcctgggacatgaatcatcccagcatgttcacactgtatatgcttcctatcctgtagttacttagtagtcatcttggttatcagaacaaacagtatgtatagggctcactactatccaagatttcaggcatccactggaggtcttggaacatatcctcccttatctgtggggactactgtactcttaaaaactttaggataaggggctgggcgtggtggcttacgcttgtaatcccaacactttgggaggctgaggtgggtagatcatttgaggtcaggagtttgagaccagcctggccaacattgtgaaacccccatctctactaaaaaaaacaaaaaaaaattagctgggtgtggtggcaggtgtctgtagtcccagctactcgggaggctgaggcaggagaatcacttgaacacgggaggtggaagttgtagtgagctgagattgctccactgtactccagcctgggcgacagggtgagactctgcaaaaaaaaaaaaaaaaatttaggataaggtcaaatggctgtaagtggaggctctatcttctattccctgtatcttctattacctgtatctctagtcccatagccccatgactttgctacacccaaggcacttagctaaatctggagagtgggcattttgggattagggattcttacatattgttttctattatgtatagcgagtcgttaatatttgatggagtttgtgaaaatccatttccttagtttttaaaattaaaaaaaattgtatagtttgtacatcataaaaatacccccaatataaatgtacagttcagtacattcagtgtaaatgttcagtaatttttagtaaatttatagaggcatgcagccatcatcacactctggtgtataatatttccatccctgctagaaagttccttctgcctggttgcagtcagccctgttcccattcctcgccccttacggccactgatttgctttgtcactatagtttttgccttctccagaaattatttccttaatagcttaccaattttatgtgtttgatttcttagcaaatttctcaggttcatccacgttagtgcatgctttagcagttcattctttttattgagcagtagtctttattgcttatccattctcagttataggacatttagattatttctagtttttagctgttgtgaataaagtgataaaactgtacaagttttgtgtgaatatatgtattcatttcttcagtgtagatagctagatgtggaataactgggcagtatagtaaatttatgtttaactttttaagaaaccaccgaactgttttccaaagtggttgtaccattatacattcccactggcagtgtttgaaagtcctgtttttttctaccatcttcacaaatattaggtattttcagtcttcctattttagtccttctggtgggtgtgtagtggtattatgcttttaatttgcatttccctaacgactaatgctgttggacatctttttgtgtgcagatttgacattcatgtttcttttctggtgaagggtctgttccaatcttttgccccatttttttttttttttttttgagatggagtcttgctcagtcgcccaggctggagcacagtggcacgatctcggctcactgcaaccaccgtctcccgggttcaagtgattctcccgtctcagcctcccgagtagctgggattacaggcacctgccatcatgcccagctaatttttgtattttagtagagatggggtttcaccatgttggccaggctggtcttgaactcctgacctcaggtgattgcccaccttggcctccaaaatgctaggattataggcatgagccactgtgctcggcctctttttgcccgttttagaattgcttttttttgttttgagatggagtctcgctttgtcactcaggctggaatgcagtggtacgaccttggctcactgcaacctcttcctccggggttcaagcgattctcctgcctcagcctcctaagtagctgggattacaggcatgcgccaccatgcccagctaattttttgtatttgtatttttatttttttatttattttttgtatttttagtagagatgaggtcttcaccatgttgaccaggtggtctcgtacttctgacctcaagtgatccgcctgccttggcctcccaaagtgctgggattacagatgtgaaccaccatgcccagcctaaaattgatttctttgccttattgagttataggattatttatttatttttttattaatttttttagagatggggtctcacaatgttgcccaggctggtcttgaactcctgggctcaagcgatctgcctgcctcagcctcctgaagtgctaggattactgcacctggccaagagttcttttttttttctttcttttttttttttctgagacaaagtcttgctgctcttgttgcctaggctggagtgcaatggcacgatcttggctcactgcaacctccacctcccgggttcaagtgattctcctgcctcagcctcccaagtagctgggattatgggcatccaccaccatgcctagctaatttttgtatttttagtagagactaaaaattttagttttgccatgttggccaggcttgtcttaaactcctgaccttgtgatctgcctgcctcggcctcccaaagtgctgggattgcaggcgtcagccaccgcacctggcctagagttctttataaactgaataaaagtcatttatcagctatgtgattggcaaatattttctcccagtctgtggcttatcttttcattttataatggtgtcttttgaagagcaaaaggttttaaattttatgaagtccagtttagcacatttttttctttttcttttattttgttaggacagtctcactccatcacccaggctggagtgtagtgatgcgatcacagttcgctgcagccatgtccttctaggcttaagtgattctccctcctcagcctcctgagtagctgggaccacaggtgtctaccaccatgtttggctaattaaaataacttttttttttgtagagacacgggtcccactgtgtagcccaggctggtctccagctcttgagctcaagcagtcgtcacactttggccttccaaagtgctagaattataggcatgaaccaccacgactggttgtgaaatatccttttttttttcatagatggagacttgctctgttgaccaggctggagtgtagtggcgtgatcttggctcactgcaacctctgcctcccaggttcaagcagttctcctgccttagcctcccaagtagctgggattacaggtgggtgccaccatgcccgcctaatttttgtctttttaatagagacggggtttcaccatgttggccaggctggtctcgaactcctgaccttgtgatctgcctgcatcggcctcccaaagtgctgggattacaggcatgagcaactgtgcctggccaaaatacctttttatttcatattgaagatgcagcttttacgtgggtgcgagagtgctataagaaaggcataactatagactctaatatttttcgagaaaaagtcattgtgtcttaaaaggaaggtaaaggatctaaagttggagaatttaatgccagcaaaggatggtttgataactgtagagaggtttggcttaaaaaaatgtcagggtaacaggagaagcagcttctgctgaccaagaggcggcaaacaagttcccagatgccattaagaaaatcattgaggagaaaggatatctgcttgaatgggtttttaatgcagacaaaaatgccctgttctggggaaaacaatgccacaaaggacatttatgagtaaggaagagcagtgagtgccaggatttaaggcaggaagagctaggttaactgccgttttgtgtaaacacagtcaagtttatgatcaggactaccctggtctataaagctgctaacctctgagccttcaagggagaagataaaacaccagctgccagtctgtttttaccaaaagaaagcctggataatgagaacccattttcttttttttttttttttttgagaggagtctcgctctgtggcccaggctggagtgcagtggcacgatcgcggctcactgcaagctctgcctcctgggttcacaccattctcctgcctcagcctcccgagtagctgggattatagttgcctgccaccacgcccagctaatttttgtattttagtagagacagggtttcagcatgttggccaggctggtcttgaactcctaacctcaagtgatccgcctgcctcggcctcccaaagtgctgggattacaggcatgagccaccgtgcccggccaggactgccttttaaagtttttttgacacaatgcccctggccactgagaatcccatgagttcaacactaggctttgaagtggtctacttgtccacaaacagtgtctctaatccagcctgtagatcaggaggtctcaaggactttttgagaaagagtctggctctgttgtccaggttggagtgcagtggggtgatctcagctcacttcaacctctgcctcccaggttcaagcaattctcatgcctcagcctctcgagaagctggaattacaggcatgctccacaatgcctggctaatttttgtatttttaggagagatgaggtttcaccattttgcccaggttggtctcgaactcctggcctcaagtgatctgcctgcctcagcctcccaaagtgctgggattacaggcttcagctgccgcacctggtccaggactttcaagactcattacatgggatactctggaaaagattgttaacaccaaggaagagaatcctgatagaatgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatgacttgatggagatgagtgcttctgtgccagacagtaaggaataagatgtacaagaaacaggggcaggaaaaaattgacattagacaatttgccagaagggttccaattattcaagacttcctttagctttgtttatggaatatggaatggaaccttctgtgatactggcactgaagtgaaagcaaatggtggaagaaggattagtattgtatagaaatgtttttagagaaatggaaaagcaaaaaagtcagacagaaatgaggatgtatttttgtaatgttacaccagatgtgcctgcctctcctgccttcctttccatgcccttcacctcttctacctctgctgccccaagacagcaagaccaaccaactccttttctttctttccctcagtctactcatcctgaagatgggtgaagacctttatgatgatgcacctccacttaatgaatagcaaatatgttttctcttatgattttcttaataacattttttctctatcttactctattgtaacaatatagtatgtaatacataaaatatgtgttaattgactttctgttgtcagtatggttaacaggctattagtagttaaattttgggggagtcagaagttatgtgcagatttttgactgcccagggtgtcagtgcccttaaccttcacgttgttcaagggtcaagtatattatcttatctattaacgtagtagagctttccatttctttagggcttcttcagtttctctaagcagtgttttctagtttccagtgtataaatctataaatcttgccttttgataaatttattctttttttttgagacagagtctcactctgtctcgcaggcttaagtgcagtagtgcaatctcggctgacggcaacctctgcctcccaggttcaagcaattctcctgcctcagcctcctgagtagctgggattacaggcttgcttcaccatgcctggctaatttttgtattttcaatagagacagggtttcaccatgttggccaggctgatcttgaactcctggcctcaggcaatccacctgccttggcctcccaaagtgttgggattacaggcatgagccactgtgtccagcctgataaatgtattcctgttttcttcttcacgcctgtaatcccagcactttgggaggctgaggtgggcggatcacgaggtcaggggatcgagtccatcctggctaacacagtgaaaccccctctctactaaaaaaaaaaaatacaaaaaactagccaggcgtggtggcaagcgcctgtagtccctgctgcttgggaggctgaggcagaagaatggcgcgaacctgggaggtggagcttatggtgagccaagatggcgccactgcactccagcctgggtgacagagcgaaacttcgtctcaaaaaaaaaaagaatggaattgttttcttcatttcatttttggattgtttgtcactagtgtatggaaatacagttgatttctgtatgttgattttgtattttgtatccttagtacatttgcatactagttcttatagatcccttaggattttctacatataaaacaaaatttttttgttttgagatggagtctctctctgttgcccaggctggagtgcagtggtgtgatcttagcttactgcaacctccgcctcccgggttcaggcaattctcctatctcagcctcctgagtagctgggatgacaggtgcctgccaccacacctggctaatttttatctgtttagtagagatggggtttcatcttgttggtcaggctggtctcgaactcctgacctcaggtgatccacccgccttggcctcccaaagtgctgggattacaggcttaagccactacgcccggcctggctgacagttttatcaggaatgggtgttgagtttttgttaaatattttcccttcatctattgagttaattatgtggtttttgttctttattcttaatatagtatatggtaatattacgttattttcagatattaagccaatcttgcattcctggtataaaccccactcagacccacttagtctggtgtagaatcattcttacatgttgctagtttcagtttgttaatattttgttgaggattgtttaatctatattcatgatagatactttcttgtgatgcctttttcgagttttggtatgaatgtaatgctagctttatagaacaagttagaaagtataccctcctctatgggatcattactatgaacatagtaaagattttcttttctttttctttttctttttcttttttttttttgagatggagtctcattctgttgccaggctggagtggagtgcagtggcatgatctcagctcactgcaacctccgcctccctggttcaactgattattttgtctcagcctcccaagtagctgggacttgaggcgtgcgccaccacgcccagctaatttttgtatttttagtggagatggggtttcaccatgttggccagatggtcttgatctcttgacctcgtgatccacctgcctcggcctcccaaagtgctgggattacaggcatgagccaccgtgctcggccagtaatgattttcaatatgaaataaaagggtattttacagccaggtgtggtggctcacatctgtaatcccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgagaccagcctggccaatatggtgaacccccatctctactaaaattacaaaaattagctgggcatggtggtgtgcacctgtagtcccagctacttgggaagctgaggcagaagaatcgcttgaacctgggaggcagagattgcagtgagccaagattgcgccactgtactccagcctggtgacaaagtgagactccatctcaagaaaaaaaaatgcgttgtttaatttcttttttttttttttttcttgagatggagtttcgctcttgttgcccaggctggagtgcaatggcgtgatcttggttcaccgcaacctctgcctcccaggttcaagcgattatcctgcctcagcctcccgagtagctgggattacaggcatacaccaccatgcctggctaattttgtacttttagtagagactgggtttctccatgttgatcaggctggtctcgaactcctgacctcaggcgatctgcccaccttggcctcccaaagtgctgggattacaggcgtgagccactgtgtccagtcgtgttgtttaatttctgaatatgtatggatttcccaactttcccttctgttcatttctggcttaattccatggtggttggagaacttcatataatttattttcaattcatttagttttttttatgatctagaatatggcctatcataagccatttcagattaagactaactttaaattaatactaatagtttcagtaaaatatagaaaatgctccagtttagctccattgtctccctcttctttttttttctttcttttttttttttttgagacggagtctcactctgtctacccaggctggtgtgcagtagcatgatctcggctcactgcaacctccacctcctgggttcaagtgattctcccatcccagcgtcctgagtagctggaattacaagtgtgcaccaccatgcctgtctaatttttgtatttttagtagagatggggtttcaccattttggccaggctggtctcaaactcctgacctcaggtgatccacctgccttggcctcccaaaatgccagggttacaggtgtgagccactgtgctcagccttctccctcttcttttgtgttactgttgtctatgtattatatatgtatatattacaaaccagaaaatacagtgttgtagttatttgtttatgcagttaaatcttatgtgttttaaataagagagaaaggaataaaatatatttacagccttttatgttaacctacagtatatttaccatttttgttattcttcattttttccctcttgatccaagttactatctgatgtaaattctctgttgattttctggatatgtatttttgaaatgcttttatgaggattataatatgcatctttaatttatcacagtccactttgggttaaaattgactaaagtctggtaatatacagcacctttgctccaaggtagctctatttcctcctttctcccttgtgttcttattgtcatgtatatctttatatgttataacctatcttatgtatatttatgaaattaagagaagaaaataattttttccatgtttacctgttctagtactttctgttccttcttgtggatccaagttttcttttttcttttttttttttttgagatggagcctcgctcccgttgcttaggctagagtgcagtggtatgatctcggctcactgcaacctccacctcccgggttcaagcaattctccttcctcaccctccgtagtagctgggaatacaggtgtgtgccaccatgcctggctattttggggttttattttgtatttttagtagagacgaggtttcgccatgttggccaggctggtcttgaactcctgacctcaggtgatccctcccatcttggcctaccaaagtgctaggattacagacgtgagccaccgtgcccggcctgatccaagttctcatacagtagcattgccattctctccaaaggacttcctttggtagttcttgtaggccaagtctactagcagtgaattctttcagtgtttatttatttgataatgcctttatttcactgttaatttttgagggatagttttgttcaatatagaatttatgcttgacagttgttttttcagtactttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgatccgcccgccttggcctcctaaagtgctgggattacaggcgtgagccaccgtgctcagcctgttgagcacctctgatcagtttttcatgccagtcattataatttttaactctagaatttccatgtggttcctcttcattttttctgtttctcggctgaaaatctctatttatcattattttttacttcgtcatcagttttctttaattctttggacgtttaaaatagttgcttttaagtgcaactacttgctcaatctagtatctgcatccaatcagagatggatgctattgatttctctttttcctgagcttaggtgacactttcctggtttttacaagtctagtaattttggttgaaaactggacatttagataatatagcaactctggattctgagttttcccccctgtggcttgttatatttacagttaattgcttagaattaaaccagaatctatttttcctttggtgtgctaatgtctctgcttagttttaaattattattagttttttcgagacggagtctcactctgtcaccaggctggagtgcagtggcatgatctcagctcattgcaacctccgcttcccaggttcaagcgattctcctgcctcagcctcccgagtagctgggattacaggcacccgccaccacgcccagctaatttttgtattctcagtagagatggggtttcaagctggtctcaaactcttgacctcgtgatcctcctgccttggcctcccaagtgctgggattataggcgtgagccactgtgcccggtcaattttaaaatttttattttcagctgggctcagtgtcctacgcctgttatcccagcacttctttttttcttttcttttctttgcttttcttttttttttttttgagactgagtttcgctcttgttgcccaggctagagtgcaatggcatgatctcagctcactgcagcctctgcctccctggttcaagcgattctcctgggttagcctcctgagtagctgagattacaggtgcccaccaccatgcccggctaattttgtaattttagtagagacggggtttcatcatgttggtcaggctggtctcgaactcctgacctcaggtgatccacccgcctcagcctcccaaagtgctgggattacaggcgtgagccaccgtgcccagcgaatcccagctacttgggaggctgaggcaggagaattgcttaaacctgggaggtggaagttgtagtgagccgagattgcgccatcgcactccagcctgggcaacaagagtgaaactccgtctcaaaagaaaataaaatattttcattttttcttcccagcctggcttttggtgggttgtccctgtatctgtttaacttagttgtcagccagtgatttgggcagaggttctcaaatactttcagcccctgaggcttttaccctatcctgatcaacttacagtcaaatgctctactgctgagctatacccccctgatcaatgtgtatgtgggtttggagaaactctaaaaaattgctgctggctctaaagtctcctttggttttcagtttttcctggttctcttaggtataatttcccagtcagtgatggtcatgtgaagagcttaactcagactttctatggctctgtttcaggattttcccattaaatctctggatgttctgcccatctaacaaagacaactgccaaagctgttcatttccatccacattcaccacttttagctggtagatccatgaattttcttcctcaccccaaattgagtccaccccctagagcagcagaactgctgattttcatagctggccccatgttgggaaaactagcattgtcaccagctgactatgctgtaagcagtggggatagaggagtagaaggatggcaggatcctaggctagaaagcttactatttttacctgaacctctagcagattttcaagaatctgtacttctcagtttgtttgatttacactgtattgaaatagttctttctgacaattttaatttttaacttttccattgtggcgaggaattgcctaccacttcatgctgtgaatacaagaatttctatgcctgtaatcccagcacaggcatggaaattcttgtattcacagcatgaagtggtaggcaagtgaggccgaggcaggcagatcacttgaggtcaggagttcgagaccagcctggccaacacggtgaaaccctgtctccactaaaagtacaaaaattagctgggtgcagtggtgggcacctgtaataccagctactcaggaggctgaggcaggaaaagcttgaacccaggaggtggaggttggcgtgagccgagatcgcgccactgcacaccagcctgggcaacaagagcgagactccgtctaaaaaaaaaaataatttccattttttcttagtttttgagcttcagagaatgactagggtctgccttactagagataaaggtaagaatagaggactaatgcccaggccacttctcaaacaagtagtattagaatcccctttgtgtcaggtagtttttttgttttttttgttgttgttgttttgtttgttttttgagatggagtctcactctgtcacaggctggagtgcagtggcgtgatctcggctcactgcaacctccgcctcccaggctcaagcgattctcctgcctcaacctcccaagtagctgggattacaggcgccgccaccacacccggctaatttttttatttttagtagagatggggtttcaccatgttggtcaggctggtctcgaactcctgacctcatgatctgcctgcttcagcctcccaaagtgctgggattatgggcatgagccaccatgcccggcctgcatcaggtagctttaaaaaaatcttctcaggcgattgtgatgtgcagttattgttgagatccagcagtttagaacagtgtttagaaaagcaagctttctctgtaaagggtgatataggaaatattttaggttttgcggtccctgtggtctctgttccaacccctcaactctgttgttgtagtgtgaaagcagccaaagacagtatgaaagcgagtagatatggctatattccaatacactttatttgcaaaaacaggcaatggctgaatttgctgaccccttgtcttggagaattctcaaaaatgattttattccaagtgtttgtatccttgttaatttaaggtagtgtgtatatttcttagcacaacccagcctttgcatttgtcattgatgtctttgaagaattagtccataatttccttcagtagaagtgttttaattgaccatgccttcctaccttctcctttgtcattaaaatatgtgagaaaatgtgccagccgtgggcaatctagttgaaaggtgtgtgttaacttttttggcccagttgggctcagtgaagccttagctggctagtgtttatggcaccatcaacaaagatggaagaattaagcctgggaaaaaggacaggaggtataaaaaatggggtccagaaattcagctgtaggagagcctggtagtggttctcctaccttctgcaaagttcagtgtcaaaactccaatcagagtctctacaagttgaactttcttggctgtccatcaggtagagtactaacttagtaagtacagtggagggccgggtgcagtggctcatgcttgtaatcccagcactttgggaggccaaggtgggcggatcacctgaggtcaggagttcaagaccagcctggccaacacagtgaaaccccatctctactaaaaatacaaaaattagttgggtgtggtggtgcgcaactgtaatcccagctacttggtaggctgaggcaggagaatcgcttgaactcgggaggcagtgaggccagatcacgccattgtgctccagcctgggcgacagagcaatactctgtctcaaaaaataaaaaaataagtacaatggagaatttggtcagacaacttatttttacatccgaggggttgggcatatgaactctgattataatgaatagttcagtagaacaaatcttattttccatagagtctactgtgagtgtatgattccattagttgagtggaacagtttttaccacgatgcttaaattctgcttcaactccctccttcccactactctattcccctgggtctcgtcagatactcctaagtcaaacaggtcatgtagcagataagtgaaggaagtaggcaggttaagtgggtaggtttgagttctgttgaggaggtggtgagtgaagatggagcctaggacctctctgattgggcagtacttgttcctaatctttatgctggggcctgggcagttacccttaatagatggaaaggtgcttagggtaggggatggtagaggacgccagagccatagattatagcctagatagtgcccataactcactgtgtgaccttgacaagctccataatcctgacgcacagtttttcagaagggagtttgtatagcgatcttttgggtcctcctaactcaatatcccttcatcacaaggctttagtctgcctttctagggattaattcctttctagtcattcattccatagttatttactgtatgctgagaacctttaccaagaattggacacagaaaggggtggagatgaagactttccaagcctggcacattcactggatagaggccttgttttcatacctgaacttagcctggtatactagctgctcagtgagtgtgtattacgtaagcaaatatcctattcctgtatactagcgagcgggattcttgtgctacatagtctatcagattttcattgcaacaaaacaacgtgaaagtcttatggattttgatttttttttttttttttgagatggagttttgctcttgtcgcccatgctggagtgcaatggcgtgatcttggcccacagcaacttctgcctcctgggttcaagccactcttctgcctcagcttcctgagtagctgggattacaggcatgcgccaccatgcctggctaattttgtatttttagtagagatggggattctccatgttggtcaggctggtcttgaactcccacctcaggtgatcctcccacctcggcctcccaaagtgctgggattacaggcatgagccactgtgcccggcaggattttgatttcttaaggtctgcagttggtttcctattttacctgtggaagcctgcaaaaatgaattttagactatcacaatttaaatatgtgactttcttgcctgtaaccccagctatttgggaggctgaggcaggaggattgcttgaagtcaggagtttgaaaccaacctgggcaacatagcaagaccctgtctctaaaaaaagaaaaaagaaaaaaattagccagatgctgtggtgtgtgcctgttttcctagttacttgggaggctgaggtggtaggatcatttgagcccaagagttcaaggctgcagtgagaaatgatcacaccactgcactccagcctgggtgaccctcggtcttctcggctcactgcagtctccacctcctgggttcaagcaattctcctgcctcagcctcccgagtagctgggactataggcacgcgccaccacgcccagctaattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcctgcctcagcctcccgaatagctgggattacaggcatgcgccaccacgcatcttgtatttttagtagagacagggtttctccatgttgatcaggttggccttgaactcctgacctcaggtgatccatccgcctcggcctctcaaagtgctgggattacaggcgtgagccactgtgcccggcctttagtttttaaaaatatacattgggtttgtttttgtttctgtttgaaaccgagtcttgctctgtcacccaggctggaatgcagtggcacgatcatggctcactgcagccttgacctccttaagctcaagtgatccttctacctcagcctcctgagtagctgggaccacaggcatttgccaccatgcctggctaattttgtttgtattttttgtagacatggggttttgcatgttgcccaggctggtctcaaactcctgggctcaagtgatccactttggcctcccaaagtgttgggattacaggtgtgagccactgcccctggttatacattggttttaaactatctggatatggtaatgacattctaataacatgtgcaatgaaggacttcttttgcataaagaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaaatcaaacaaatgggaaaaaaacgcttatttttcacaactgtgctctgttggtgaaagcatttggatggaagctggaagcatatatgaaagaatggtagccaaaaatcacattaaaattttttttttcagaacatgagaatttttgctcttagtaactgtgttaccctggacttaggaagttgttacacactttgtagatgcagtatctttaggtcagcttcttaatgtttcagggttttttgtttctttttcttttttttttttttaacttaacaaaatcaaatgctttcaaacagggcccgactcttaattgtaatggagatgatggaagggggagagctatttcacagaatcagccagcaccggcactttacagagaagcaagccagccaagtaacaaagcaggcaagttaaccccaggtaccaatcaaactgccaccaaagttggttaacaagcacaatttcattggggggaagaaaagaaaacttaaagaaaagctctatttgacttctcattgcctgctttgttatgtaatcagaaaagatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaatttcaggatgccccagtgaagttgtgtgactttggatttgccaagattgaccaaggtgacttgatgacaccccagttcaccccttattatgtagcaccccaggtaagcatgtgcggtttctgtcctaagatctgtcaccaagctgcccatcaactcgtgttccttctattctacagcacaagtaggcatatattacagatgggagggggagaacttagctttagaaacctacagattgctttatttggtgtagatcttttattcttttaaaatcaactttagccaggtgcggtggctcacgcctttaatcccagcactttgggaggctgaggcgggtggattacaagttcaggagatggagaccatcctggataacacggtgaaaccctgtctctactaaaaaaaatataaaaaattagccgagtgtggtggcgcacacctgtaattcgtgctactcaggaggctgaggcaggagaatcgcttgaacctgggaagtggaggttgcaaggagccgagatggcaccactgcactctagcttgggcgacagagcgagactccgtctcaaaaaaaaataaataaaataaaataaactttattgaggtatgatttagaagtatgatttacatacagtaaaatacctccacttcaaggagagtttgatgagttgtgacaaatatataccccatatggcgaccaccacattgaagatgtggaacacgcccctcacttcacaagctgcctgtgccactttgcagtcagtcccctcccaacttaacccctggccctaggcaaccactgacatgctttctgtcattattggttagttttgcctgttgaagaatttcagaaaaatgtaatcgtggactttgtatgcttcatttcttttgcttagcatgtttttgagatttgtccatgttcctgcatttatcactcgttaattccttttcattgccaagtagtatttcattatatacctaagctgcatttgttttttccattcactgacaggattttgggttgtttctcatttttggctattatgaagaaagctgctaggaacacttcttttacagtttttgggggacatgttcccccatgcccatatcttttttccaaaatggctataccattttatgcgtctaccagcaacgtatagagttccagtcatttcacatttttactaacgcctcatgcttgttgcttgtcagcatttgtcatcttagtcattctggtagcgggcagagtattacttcattatagttttaatcacgacattgtcctgatggccactattttggagcactttttgtacatgtgtattggccattctgttgtaagtatgggcattcatcttttgccattttgttattgttggtttcttgttaaagaattgaggtataagaattttaaaatattctggacacaggttctttgccatatgtatgttgtattcttactgctgctgtaacatattgtcacaaacttagtagataaaaacaacagaaatgtattatcttatacttctggaaatgagaagtctgaaatggtactcagtgctataatcaaggtgtcagcagggctgtgttccttctggaggcatttcttgccttttccagcttctagaggctgcctacattatttggcttgtagcctcttccttcatcatcagagccagtagcatagcatcttccaatgagtgtctctctctatgactttgaccctcttgcctgcctcttataaggaccctactgatcacattggccttacctagataactccccattttaagattcttaacttaattgttctgcaatacaaggtaaaataatcccagggattataacatggacatcttggggggccattattctgccttccatatatatatcatgaatattcatctcagtctgtgacttgccttttaattttcttaatggcctttgaatagcagaagttttgaattttaatgaagtctgtttcaccattttttttttaatgcttagtactttttgttcctaagatccacaagcataaatattttctctgatgttttcttataagaggttatagctttagcttttacatttgggtctgtaattcatctgagtttgtgtgtgtatgaaatgagagaccaggttctttttttcccccttaagggtgtcaagttgttgcagcatcattggtaaaatgttttttacaaatcatcatttgtaaaaggatttgtaaaaggattgcatcattgaattgcagttttttgtttgtttgtttgtttgtttttgagacggagtttcattctttttgcccagcctggagtggtgcaatggcgcgatctcgactcactgcaacctctgcctcccgggttcaaggaattctcctgcctcagcctcctaagtagctgggattacaggagcccgccaccatgtccggctaattttttgtatttttagtagagacggggtttcaccatgttggccaggatggtcttgatctcttgacctcgtgatccgcctgcttcggcctcccaaagtgctgggattacaggcatgagccactgcgcctggcctgaattgcagttttgttgaaaaccagctggccatatatctgttggtcttttctggattctattctgtttgtttaatatatgtatgtgtctatagcaagagcatctgcattattgtagctttatattatatcttgacttcagattcattctttttcaaaattgttttggctattctagatcctttgcatttctctacattttagaattcacttctgtataacagaaaagcctcctgggatttgactggggtggtatttaatctataggtgaatttggagagaactgatatcttaacaatataagtctcccaatcgatgaacaaggtatatatctctccatttgtttaggtctttaattttcctaaaaaatgtttatgcttcttaatgttacaggtcttgcacatattttcttaaatttatccttaaattttgtttttggatgctgttggaaatgatattgtaaaacatttcagctgggcgtggtggttcacgcctgttataccagcactttgggaggctgaggcaggcggatcacctgaggtcgggagttcgagaccagcctggctgccatggtgaaaccccatctttactaaaaatacaaaaatttgctgggcgtagtagccggtgcctgtaatctcagctacttgggaggctgaggcaggagaatctcttgaacctgggaggtggaggctgcagttagtcgagatcatgccattgcactccagcctgggtgactagagtgaaactgcgtctcaaaaaaaaaaaaattcattttctaattttaactagtttatagaaatactagtgttttttgtttgtttgttttgggtttttttttttttttttgagatggaattgcactctttgttgcccaggctggagtgcagtggcgcaatctcagctcactgcaacctctgcctcctgggttcaagcaattctcctgtctcagcctctgggatgacaggcgcccgccaccacacctggctaatttttatatttttagtagagacagggtttcaccatgttggccaggctggtctcgaactcctgacctcaggtaatccacccactttggcttcccaaagtgttgggattacaggtgtgagccactgcccccagccatactagtgactttttttttttttttttttgagatggaggcttgctctgttgcccaggctggagtgcagtggcgcaatctcggctcactgcaatctccgcctcccaggttcaagcgattctccttcctcagcctcccgagtagctgggactacaggcgcccgccaccacgcccggctaattttttttcatatttttagtagagacggggtttcaccttgttagccaggatggtctcaatctcctgacctcatgatctgcctaccttggcctcccaaagtgctgagattacaggcgtgagccactgcacccggcccatactagtgatttttgtatattgactttgtgtcttgggaccttcctaaattcatttattaaatctagtaaattttttgtagatttattaggattttcttttttttctttttcttttttgagagcctaaaagtgggcatgcctcttctgttgctcggcctttagtgttgggtttgagggttaaatcagtctactcaaaagttgagctgagtgtgagttttgttgttgctatcgttgtcttcagtgcctcagtggcatgggattcctgttttgttaccttatggttaggtgggatctgaaatgccattttttttaaaatttaaaaaaaatttttttaaaatattccacttctaccctcagtcttggccttgctagtgcacctgtacctcagaggggatctctctttacagtcttggcccccccttagcaatagattgctgtcagttactgcttggtccctgcaagcctgcagaaagggagatggcaatgggggaccgagaggtatctgtttctctgctgttgggcaggacctgtgttcttgagtctcatgaatatctggtggaagtctgtgcagaagagtatgggagcaggcatgagtcttccttgtttgtatggctcctagagggtctgtactcttatcctagcccacattttgcctttagcagtttgttaaaaacctcgctgaattctttttacccaaatggcatgtgatatcacttcctcctgcgctctgccataggtgagccagctttcactccccatctctccttggaagggcctgacttaaagatttccgaataattggttaacctgagacctgatctttgatgggttcaaaaaaagtgatgggccgggcgcagtggcttacccctgtaatcccagcagtttgggaggctgaggggggtggatcacttgaggtcaggggttcaagactagcctggtgaacatggtgaaaccccgtctctactaaaaagacaaaatattagtcgggtgtggtggcagccacctgtaatcccagcttctcgggaggctgaggcaggagaattgcttgaacctaggaggtggaggttgcagtgaacaaagattgagccattgcactccagcctggtgacagagcgagactccatctcaaaaaaaaaaaaaaaaaaaaaggatgattttataatttatctttgacactttccagctttctatatcctagcagaaacagaaatcccaacaatttgggtggaaggagggtgaggatcaaaaaactacctatgtggtattatgcttatataaaacctgggtgatgaaataatctgtataccaaacccctgtgaagacactgcagttcacctatataattaacatgcataaagcacatgtacccctgaacccaaaataaaagttaaaaaaaaaaagtcccaacaatttgattatgtatgcattcttgttcctttgtttttcctgccagggatctcttgagctcctgggatctgttggtttatggtgtttatcaaataaacaccatatcaaataaaaattaggaaatttttcagacatcatctcttcaacgatttttctactcctctacttgttttctgagacttccaatcaatgacatatatattagactgtacagggaactggagttctgatcttttgtattttcatccttttttccttttctttcatccttttttttctttctgctttcccttcccttcttcccttctgatatatactcaatagtggcactgctggatgataaggtatttctagttttaatttttttaggaagcttcccactgttttccatagtggtcatactaatacacattcttacagtgtacaaaggctcccttttttccacatcattgttaacacttgttatcttttatcttttttaatagccactgtaaaaggtgtgaggtaataatttcattgtggttttaattttaattttaatttttttttttgagatggagtcttgctcctggcacaagttggagtgcagtagcacgatctcggctcactgcaacctccacctcccgggttcaagcgattctacttcctcagcctcccgagtagctgggattaaaggcatgtgccaccacgcccggctaattttttgtatttttagtagagacagggtttcgccatgttgttcaggttggtcttgaactcctaacctcaggtgatccactcgccttgacctcccaaagtgctgggattacaggtgtgagccaccatgcccagcct

SEQ ID NO: 585 - DNA, 134645 bp, Homo sapiens
gaatctgggaacatggttgttttgaaactagatgctcttctaaattttagttgaaggtggcagaaatctttacctcaactcctttcctcaaagcccactactatgatagtaaaattatttcattttaaagacctagagggcaaagagaaaatgacatagaggagttgatagcaatacaattttgaaagctggtagtagagggatgagtagcgaagacttagcaaacttgaaaaagtggatcccaaactggcagagggaaaaggaaaaaaacattttgatttgcccctatagaaccctgaaaatcacaggaagtgcagtactagaaactctagaagtaaagatgaagatgggaatgaagaccaagggactggttggctgtacacgtaagaaacattcaggccaggcacggtggctcgcacctgtaatcccagcactttgggaggccaaggcaggtggatcatgaggtcaggagttcaagaccagcctggtcaagatggtgaaaccccgtctctactaaatacacaaaaaattagtcgggcgtggtggcacgcgcctgtaatcccagctactccagaggctgaggcagagaattgcttgaacctggaggggctgaggttgcagtgagccgagatcgcgccactgcacttcagcctgggcgacagagcaagactctgtctcaaaaaaacaaaaataaaaataaaagaaacattcagatcctcaggccctattccccactccagctggggaacagcctcttcctaaccttggcagaagattttatgtttatcttccatagaatataaaacagaagttctctggacagagaacagcaggtactgctcaggatgggaagaaaatagacaagaaaaatttatattctgaatgttgtaatcccaactcaggtctcattttgggcaatcaaatttgtatcctccaggcatctcaaattaatatcatctaggaatagttagaaatgcaaattttagggccttacccaagaccgatggaatcagaaactctatgggtagggcccagcaatctgtgttttaacaagccctccggacatacccgtctctgaagaggctcacaagttcaaaagaaaagacttcagaaaagcgagttttcaatgaaacagtccagccagagtgaagcccagaactgacaagtaccatccatgtggaacttttcacttaatttagcctcattcttaaatagatgcagtcaagattgacaaggcatgcgtttaacatgaagaagatctatccaaaaaaaagcagcagaggtgggaagcaacttagaagaaagacattttgcagggagattaaaactttaggaaaaaatcattgatgtcctcagaaagataagagaaggtacttgccattataggctgttaataaattaaaatatgttagtagaagttttttaaaaaatccataaaagacttaaaaagagaaagttgagggaatctcccacaatgtagagcaaaaagacaagagtaaaaatgggagaaaaagataaaagaattagctcattctgcccaatgtttgactaatactagtttagaaagagatagcagaaaaagcacagaagagaacattttcaagaattaaaggacagaggtttttagattcagataaaccattaagaacccagtggcactaatgcattggccctctgtccaggtgacactgagaggtgacagcgtgctggcagtcctcgcaaccctcgctcgctctcggcgcctcctctgcctgggctcccactttggcggcacttgaggagcccttcagcccgccgctgcactgtgggagcccctttctgggctggccaaggctggagcctgctccctcagcttgcggggaggtgtggagggagaggcgccacgggaaacagggctgcgcgtggcgcttgcgggccagcgtgagttccgcgtgggcgtgggctcggcgggccgtactcagagccgccagccagccccgacccacccgccacgggcagtgaggggcttagcacctgggccagcagctgctgcgctcagtttctcaccaggccttagctgccttcctgcggggcagggctcgggacctgcagcccgccatgcctgagcctccccgaccccctacggtgggctcctgtgcggccggagcctccctgacgagcgctgcccccagtcccaccgaccacccaagggctgaggaatgcgggtgcgtggcgcgggactggcaggcagctccacctgcggccccggtgcaagatccactgggtgaagccagctggcctcctgagtctggtggggacttggagaacctttatgtctagctaagcgggaccaatgggcactctgtatctagctcaaggtttgtaaacacaccaatcagcaccctgtgtgtagctcaaggtttgtgaatgcaccaattgacactctgtatgtagctactctggtggggacttggagaacctttgtgtccacactctgtatctagctaatctagtggggatgtggagaacctttgtgtctaactcagggattataaatgcaccaatcagcaccctgtcaaaacagaccacccggagctctgtaaaatggaccaatcagcaggatgtgggtggggccagataagagaataaaagcaggctgcgggagccagcagtggcaacccactggggtccccttccacactgtggacctttgttctttcgctctttgtactaaatcttgctgctgctcactctttgcgtccacactgcctttatgagctgtaacactcaccgcggaggtctgcagcttcactcctgagccagcgagaccacgaagccaccagaaggaagaaactccgaacacatccgaacatcagaatgaacaaactccggacacgcggcctttaagaaccgtaacactcacggcgaaggtctgcagcttcactcctgagccagcgagaccaccaacccaccagaaggaagaaactccgaacatcagaacgaacaaactccggacacgccgcctttaagaactgtaacactcaccgcgaaggtctgcagcttcactcctgagccagagagaccacgaacccaccagaaggaagaaactctgaacatcagaacgaacaaactccggacacgccgcctttaagaactgtaacactcactgcgagggtccgcggcttcattcttgaagtcagtgagaccaagaacccaccaattccggacacaacatcatcacacaattttagaatgcgaagataatgaaatgggaaaagttcccttgtccgcctcgcacagcgtgtgatggggatgtgactcgcttcttcagtgccccactgctcagacctctaggggagcatacagatgggcaggctgtggggctctgaccccatggcattgtctaggggtgattgtttacagctgaagccccagtgggcgtgtgttacaggttgctcttttagtttaactgtccgtaggtgacttgtgttaactagctcaatcagaccctctaccttgccgcaaggacagaggactttctgtatcctgggttcttgcctcggtgtaccggaagaatcggatcacaccggggcttggagaatgagtgcaaggttttattgagtgggagtagctctcagcagatggggagccagaagaagatggttttccctagagtcgggctgctcagcgtttggactctctctgactgccccagccaaactctgcattgttctgatggtcagtggcctgccggcgtctgtctgtgtgctcttccgctggtgcgctcccctggacgtcctctccacgtccagccacttgtgtcttcttcagaggatgtgttcctcttgatgtccagccgcttgagtgtgtgcctgctagagtctcgggggcttttataggcacaggatgggggcgtggcaggccagtggaggtcttgggaaatgcaacatttggtcagaaaaacaaaaatgcctgtcctcacttaagtccctgggcacaggcccagaagtagagccgtagccagggaccacgcccttcccttcccccttccgtatcatttaaagggaccatgtcctttccagtacttccctctgtatcaataagaccctataaacttctgaaagtaggtcacctctaaaggatcaggaatcagaatagctttggtcttctgaccaacagtacttggatgagcagtccaacaattggtttaccaattcacaagggaggtgatgagtatctcctagatatggggcagataagtcccaggatcatagcttggcaccaggcctagagagcaaccagtccaaacaagagcagcctcaagggagatgtttttgagaaggtaaaatagctagaatacatgatatgtttgaactatcgagagggattttaaacaattgggatagtgttttggtatgagtctgttataagtacaaagcaaactaaggaaatgaaaaaaaaccaataagaatatcaactccagggaaacaaaaagttgtgcaaggaaagaaaagtaatcctaatattaggatggctcagctgctaatatttttgataccaaaccaggttcatccttcctacgcacagtaagtcaatcactgtgatgacaggtttgcaaaagagagaagattttaatcacaaggctgccaagtgaggagatggaagaacaaatttcaaatctgcctccctgacaatagggcttggggggcttatggcataaaggagtggtctaaagcattgggaaaggtggttagtgggtaggaaaggtgaggtagtcggggttctgccaagtgtaatctacatggctcttcatgtctaaaacaccaaaagcaatggcaacaaaagccaaaattgacaaatgggatctaattaaactaaagagcttctgcacagcaaaagaaactaccatcagagtgaacaggcaacctacagaatgagagaaaatttttgcaatctacttatctgacaaagggctaatatccagaatctacaatgaactcaaacaaatttacaagaaaaaacaaccccatcaaaaagtgggcgaaggatatgaacagacacttctcaaaagaagacattcatgcagccaaaagacacatgaaaaaatgctcatcgtcactggccatcagagaaacgcaaatcaaaaccacaatgagataccatctcacaccagttagaatggtgatcattaaaaagtcaggaaacaacaggtgctggagaagatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccaacaatgatagactggattgagaaaatgtggcacatatacaccatgggataatatgcagccataaaaaatgaagagtttgtgtcctttataggcacatggatgaagctggaaaccatcattctcagcaaactatcgcaaggacaaaaaaccaaacaccgcatgttctcactcataggtgggaattgaacaatgagaacacatggacacatgaaggggaacatcacacaccgaggcctgttgtggggtggggggaggggggagggatagcattaggaggtatacctaatgtaaatgaccagttaatgggtgcagcacaccaacgtggcacatgtatacatatgtaacaaacctgcacattatgcacatataccctagaacttaaagtataataataaaaaaaagaaacaaatgatggcatgagtaagtcatcttactcattataaacttgtagaagattataaaactgttcaaaaaatgactgggatactacagatgtcggtttcttattgactcacataattaagagttgctgatactataaatttttaaataataaaacattttaagcaaaaagaaaaaaaagaaatagtaattaatgatacttgttaaagatggtaaggcagactttattcatggactatcatggccataggtatagggaccactgcaacaaggtcttgtacttagggagatactagaatcaacttttactccaacaaggacaggtggagatttataatgaggaaggagagtgtgtgtgagtggtggtggtgaacggggggagtcagtcgatggaaaattactgaaaggaaccatcagtgacaggggtttctggctgaacagacttgataggattattactgaagaccggccagggggctcaaagattgagggtggtcagatgtcaaagagtggagattttcgctaatttaatttagcagcatttttctcagactggattcatcaaggacagagaggggagcccaaggataggcttagtcagaaagggctcaggaccctgactaaagtcttagtcaaagcagagagtctttatcactcttttctgtaccctgccccacaaattccagctgcttcagctgcctgaaatgtgggtttctgccttctctgcttgggaagcacacctgtctcacctatggcagcctgggtctcactgctctgtgcaatgggaagaaaactgacctagaatcaccccacatggcttctgtgtcttaaggatcacagtcctgcacttcctgccctcagtgcttgaaaacagttgcctcacacgtgtccatttccttgtcattttcaatgtgagaggaagtccagtgccaattactctgtcgtgacaggaagaatgaattgtagaataatgtaggatgatttgactctttaacctgtaacttgaccttaagcacagctggatccaaacaaacgcatcagaccggtctctctctccactcctaggctggtttttctggcttaacctccaggcgcactctgcccacatagtggcaaagatggctactggcagctgcagcttttcttgtgtcagtttaaccatcccccagggaaagagagcacctttcttcaatagttctagcaaatatctgaactagctttcattggcctgccttggactaggtgcctatgcctgaacgatctctgggattctgattggccaggccaggctcagggggagggggcaaggaatgagaccagcttaatgcaaacctggtgcactaaggggaggcatatttttccaaaagaaaatgggagtgctattaccacaagaaggaagaaggaatgttgggcatttccagcaaaagtacttaccgtattccaagcactctcaaggtttagttcaaaggtcatcttctctataaagcctttttgtgtcctactcgactatagacatcattagtcaatcttttaattcagttttaacttttacatatatctatcttaaaacaaatcactcgtcttttattataatcagtatttcacctttttgcttccttcaggctccttgaggacaaagagtattttatttacatttgaattcatttattcattcatttagttaacaaataccgtcttggttcacttaatgacagggatacattctgagaaactcaccattaggtaatttcgtttttgtgcaaacattatagagtgtatttatgcaaaccttgatggtatagcatcctacatacctaggttatgtggtatagcctattgcttctaggctacaaacctaggagcaatgtgtttgttactgtactgaaactataggcaacggtaacacaatgataagtatttgtctaaacatagaaaaagtacataatgtgtggaataaaatatatatattttttgagatggagtctcgctctgtcccccaggctggagtgcagtggtgcaatctcagcttgctgcaacctctgcctcccgggttcaagcaattctctgtcccagcctcccaagtagctgggattacaggcgctcgccaccatgccgggctaatttttttgtatttttagtagagccggagtttcaccatcttggccaggctgatgttgaactcctgatctcatgatccacccacctcagcctcccaaagtgctgggattacaggcatgagccaccgcgtctggcctggtagaaaagattttaaaaagtatatctgtatagggcacttaccaggaatgaagcttgcaggactggaagttgctctgggtgagtcggtgagtgagtgtgagtgaatgtgaaggcctaggatatgactgaacactgctatagactttagaaacactgtacacttagactacactcaattcatttaaaaatatttttctttcttcacataataaattaatcttagcatactgtaacatttttactttataaactttttaaattttttaaaacttcttgactcttttaaataacacttagcttaacttacaaatacattgtacagctgtataaaaatatttctttatatccttattctgtaagctttttcctattaaattttttttaactttttctgttaaaaactaagacacaaacacacacattagactaggcttacatagggtcagaatcaccaatatcacttacttccacctctacgtcttgttccattgtaaggtcttcaggggcaataacattcacggagttgtcatcagctatgataacaatgacatcttctgaaatgtcctctgaaggacctggctggggctgttttacagttaactttcatataagtataagtagaaggagtatactctaaaataaaaataaaagtatagtatagtaaatatataaaccagtaacagagatgtttgttatcagtatcaagtactatgtactgtacctaattgtatgtgctatacttttttaggactggcagagcagtaggtttgtttacactagcatcatcacaaacatgtgaataacgctttgcgccaaaatgttatcatggccaggacctcactaggcaatagaaatttttcagctccattatgattatatgagaccaccattgtctatgtggttcatcattgaccaaaatgtctttatgtagtggatgactgtgtttattgagtgcttattatgtaccagtcattgtgctaaggctagaaagaaggtagagtccaatatacatacacattgtccctgtactaacaaggtttatttttagtggggaagataaattaataaagaaggaattagaaagtgtgtgttgaatgttataatacatgttttaaaagggtactgtgtgatggaatgattcctgaaaggagtggtgtttaagctgacacctgaggaatcacctgaggaatcatgagttagcatgatgaaggaggactggaggtaggtggtggctgcttcaggaagaacaaagggcctttgtgaaacccttgaggcaagagatgataccaagagttttcaaggaactgaatcttatatagtgcggaaacagtacatataggccagaccttggaatgcattataaagtgtgtaggctgtttggattttaccttaaggacaatgaacaaagggttttgaataagggaataacatgatcatatttatatttggattatcctgggtacagtatgggaaggaaatggaagaggagcaagactaaaggcagggacaccagaggatactgtagtagtaacaagtgaaaatcgatagtggcttggaccaaggttatgtggagaggatagggagaaaaagacagatttgggaaaatgtaagccctacaattaagagaaattcatgatggattgcaaggaagaaagtggaagggagaaatgaaagagacagaggaataaaacatgactcctggatttctagcttgaacactagattgcatagcactggattgcacagcagaaccatttcttgagattgggtactgttaagcaatggcaggtcaaaggaaagtgagggtggagaagcaatgagctctaatttcattatgatgaatatgaggtatctgcaagatagacaaatggagaaacctagaggtaattgaatatatgatctgtcattcaacaggaagccctgagttggaaataaggatttttttatccacttgtagacattaattaaagacttggatatgaaatggtctggagagaatgaagaagggctataatgggctccagaggaacaaccaaaaacgaagggtcaagtagaggagaaacagccagcaaagaactgtgaagactgcccagagagataagaaaatacaggtgagcgtgacactgaggagttctgggaatacagcttttaagaaggaaggactggacaaactctttaaaatgccatcaagaaacgtgaggactaacacatgtccatactccccagcacagaacctgactgcattcacatattcatttgtcaaatgaatccttattaaacatctttatttcttgtccacggtacattatttctcatcccgggagcatgagacaatgactacaaggctgactagcacctgttatacctgagttccattggctgaggaggttttgttctcaaggatgggtcattatattgttttctgctgcttgtcatgaaaaaaggtataatgttttattgtgaattactttaattaaaacaacttcatttagaaggcttaaatttaactgttttgttcacagaatataggactaagaaagaaatagctctccaggactagggggagtgggagtgagggtctcatataaatcagaaatctatcaaaaaatgaagttgggcaccatggctcaggcctgtaatctcagtacattgggatgtcaaggtgggaggattgcttgagcgcaggagttcaagaccagcctaggcaatatggcaaaccccatctgtacaaagcaatttaaaaattagctgagtgtggtggcatgcacctgtagtcccagctactgaggagactgaggtgggaggatggcttgaacctaggaggttgaggattcagtgagccatgattgcaccactgcactccagcctgggtgatggaacaagaccctgtctcaaaaaaaaaaaaaaaaaagcattttcttttcttttccctaaacaacctcataggtacaggcagatgagcatgcccagagtatcaaccatctccttcatccacaggacaggattaataacaatgactgaaggcattggatgcctactaggggctgtacactgtcagatattttacaaacattcatctaattctaatacaacaaaagacatccaacaccacacaaggaaaactgagaaaatgtacttgcgacaagtgataaatgaaaggttaacactaataatataaacagaactttaaaaacttaataaaaacgggaaataatagaaaaaaatggacaagggatatcaataattaatagaaaaaggtaaaaaggctaatattcatatgaagagatgttcaaactcatttataatttaaaaatgcaaataaaaacaagataaaatcttttctataaattggcaaaaattaaacagaaggattatgccagcattggtgacattagggcaagagggcacactcttatgttgcaatattttgagagtctctttcaacattttaaatccttaacttataacctaataggtactactacgtgccagcataggttgtatgaatgtttgtgaacaagaatgtactattatttgtagttttttaaaaattggaaatggcctaaatatggaaccaggagcatataatgcaactattaaaaattaagggcgggcgcagtggctcatgcctatagtcccacttacttgagagactgaagtggaagaattgtttgagcccaggagttcaagacttcagtgagctatgatcacaccactgcactccattgtgggtgacagagtgagatcctgtcttaaaaacaaaacaaaacattgagaagtatctattaccaattttgggagatgtctgtgatatattgttatgtgaaaaagcaatttagaaaatatattaacattttaaataacatttttaaaaacctctaatttgatacagaaaattagcatggcgtggtggtgggtgcctggagtcccagctgcttgggaggctgaggcagaagaatggcgtgaatacgggaggcggagcttgcagtgagccgagatcgcgccactgcactctagcctgggcaacagagcgagactccctctcaaaaaaaaaaaaaaaaaaaaaaaaaaaacctgtaatttgaaagctgtatatgtgtgtatatatatattatatatagacggccagataatgatatatcatattagttttctattgctattacaacaaattaccacaaacttaatagcttagagcaacacacatatattatcttacagttctacaggcggaagtaagaaatactcttcactggtttaaaatccatgtgccggcaagtctgtgctcctcctggaggctccaagggagaatccatttcctggcctttcccagcttctagaggctgcgtgcatgtcttggctagtgtcccatttctccatgtgcaaagcctgcaatgttaggctgagtcctcatgctccatctttttggttctgcctcttttgcctccctcttctattttcaaggacccttgcgattacactgagcctacatggaaacccaggataatcttgttatctcaagattaactgattagcaaattgaattccatctgcaacctgagttccccttggccatgtaacaacatattgactcgttctggggattaggatgtagataccttttggtggggagagcattgctcttcctatcgcacatatgcacatatctatattcgtataagtatccaaaaaagtctggatgtatatatattgaacagtgatttcctctgagaggctgtatttgaatgtaccttgaaaaattaaataccatatatgtgttaagtattaataattattcaatatggatgtaatgtaatattgtaaattaaacttgtcacttagtggcagtatatccaccaaagaataatatcagaggaattaaaaacaaatgtgtctgttctgatttatgacactaaagaaagaaagagataaatctacaatcatagttgaaggttttaacatcttctctcagtgattgacagaacaaggagacagaaatcagtgaggaaatagattatttgatcaacaattttaactaaattcatctggttaaaaatgtgtagaactatgcacccgactacatcagagcacacattaacttcaaacgcagagagattattcaccagtatagaacatttgatgggacataaagcaaattgcaataagtatcaaagaattgtaatcatacagagtgtgttctctaaccacagtggtattgacttagaatcaagtaacaacaaaatatcgagagaatcccccaaatacttaaacaatacacttttaaataacccgtgggtcaaagaggagatcacaagggaaattagaaaataattttaacttactggcaatgaaagcacagcatgttaaaatttgtgggcttcagtaagagcagtgcttaaaggaaaacttagagctttaagtgcttatattaggaaagaagaagggtacacctattatgtacctacaaattgttttttaattttaaaaattaaaataattatatgataaaaatgatcatatatgcaaagcaccctatgtagttcttgacatatatttattatttaaagaaaacttccctgttttggaaaaaaaggaaagaagaaaggaataaaatcaattttaattaccaatttaagaagctcaagaaaggagcaaattaatctcaaaagcagaagaaaggaaataataaaaatagtggaaatcaatgaaataaaaaatagactaatagaaaaaaatcaacaaaatcaaaagtttatttttgaaaagattaactgcattgatacatccccagcaagtttgattttaaaaagagaaaggaaacacaattcaccaatatctggaatgaaaaaaatggacaccgctataaattctacaggtattcaaaggatagtaagttaatattatgaacatttttatgcccatcaatttggcaacataaaatgaacaaatttcttgaagaacataaatgaccaaaactgatataataagtaatagaacatctaaataaccacatatctattaaggaaattgaatttttaatcaggaacttacctacaaagcaaactacagttccagatagcttcattactgaattctaccaaatattaaaggaagaaataaaaccaatgctacacaaactccttcataaaatagaataggagggagcagagctcagcttattttatgaggctagaatagccttgatacctaatgaagatatcacaagaaaagctgatcatagaccaatatcctttataaatgtaacagaaattgtcacaaccccgcaatatacacaaaggataatacatcatgacaaagtggggtttatcccacaaatgcaaggttgatttaacacttaaaatcaaaccaaattcaccacttagtagaataaagcagaaaactcatattagatgcagaagaatcacttgacaatgttcaatactccatctcgctaaaaacctctcaaaacctctccaaacaaacttagagaattcacgagacaattctgaaggctgctctgcctgtacctacacttcacccatttttaacaagttggtctttgaaaagaaccctggagttgaaccaggattgttttctgccacaaatatggaggaattccactttgaaatacacagtgcagtcagtgtgcagatgggcaacagaaaaatgttgtggccaactgaaaaatgttctccccaaggaactcaataccagaaccattaagagtacttttcagcctttgctttctactggaattacttggggagcttcaatgctttggcagcagtttttgtttttgttttttgtttgttttgttttgttttccagcattatttctctttctcttttaaaaaatactttaaattgaggtatatataacatccagtacaatgtacaaatcttaagtgtccatttcaatgaatttattattgttatgaactgtagacaacatgaaatttagcattttaaaccattttaactatattattcagtgacattaaatactttcacattgttgtacaaccatcaccactacatctccagaacttcattttatcaaactgaaactgtatacccattaaacagtaactcctcattctccactgccagcccatatcagacacaattctactgcgtctctataaatttgactattctaggtacatctaagtggaattatacaatatttgatcttttgtgtctggcttatttaacttagcaaaatgtctcaaggttcatccatgttgtttcatgtgtcagatttttctttctttttaaggctgaataatattccacggaatgtatataccacattttttaatccattcatctgtcaatggacacttgagttgcctcccccttttcactactgtgaataacgctactctaaacatggggtgtacagtatttgtttgactccctgcttccaattattttgcgtatatacccagaagtgaattactggatcacatagtaattctatgtttaattttttgaggaactaccatactctttcccacagtatggtagttcctcaaaagcagctgtataccattttatattcccaccaacaatgcacaaaagttccaatttctccacatccttgccaacatttgttatcttctgtttttttttgttttgttttgttttggttttttgtttgtttttaaataatggccatcctaatgggtgtgatcaatagttttggcaaatatctatatttgtgaaagctaccatcacccaaaacaaaatatagagcattccatcactgcaaaaagcttccccggctgggcacggtggctcacatctgtaatcccggcactttgggaggctgaggcaggtggatcacctgaagtcaggagttcaagagcagcctgaccaaaaaggtgaaaccccatctctactaaaaattcaaaaattagttgggcgtggtggtaggtgcctgtagtcccagctacttgggggggtgagacaggagaattgtttgaacccaggaggcagaggatgcagtgagccgagatcgcgccactgcactccagcctgggagatggagcaagactccgtctcaaaaaaaaaaaaaaaaaaaaagcttccccatgttctttcccagtcaattattcactcccctacccttgctcaacaattgctctctgacttctatcaccaaagattattttcctgttctcgaacttcatatgaatgaaaccatacatacaagtatgaactgtttgacttctttcattaaatgtaatagttttgaaattcatccatgttgtatggatgttaccactcttttttactattgagtggtaagctattacagaatatactgtgatggatttattcattctgctgaggttagacacgtgttgtttcaagtttggggccactattcataaggctgctatgaacattcttataaaagcctttttgtgaccatgttttcatttaccttgggtaaatacctaggaattgaattgctgagttattgctgatatgtgtatgcttattttataagaaagtgccaaataattctccaaagtagttgtactattttataatcctaccaataatgcatgaaagttccagttactccacattcttatcaacatggtcaatcttttaattttttccccaccattctatcgagtatgaaatagtatcttattgtgtttttgatttgcattttcttgatgactttgtcatcttgaggcttcgtctaccttttcctgtacttactggccaatgatatcacttcctttaccaagggtttgtttaagaattttgcccatttaaaaaactcagacttatttttaaatttataggacttctttttatactctgaatatacctatgccatttataggagctacgaatattttcccagtctgtagcttgtcttttcagtttctaaataacatcttttgatgaatagaaatgtttaattttgatgaaagccattttatccattttttttaatggttagtaccttttgtgctctgttcaaaaactctgtctactccaaaattgttaagatgttctcttatgttttctttctaaaagctttcgggttctgggctttacatttaggtctcagttagtccatttttttgttgctctaaagaaatacctgaggctgggtaatttatcaagagaagtggtttattttggttcatgtttctgcaggctgtactggaagcttacaatcacagtggacagtgaaggcagagctggtatgtcacacggtgaaagaagaagtgagagagagacgggggaagtgccaggctctttaaatgaacagatctcatgtgaactcagagcgagagcttactcattaccatggagatggcaccaagccgttcatgagggatctgtctccgtgaccccaacacctcccaccaggccccacctccaacattggaaatcacatttcaacacgagatttggaaggacgaacatccaaactatatcaaggtctataatctatctcaagttaattcttgtgtatgtagtgagaaaggggtttattatttttttcatgtgaatattcaatttttttgagcaattttttttttagaaagacttccctgttctccgttagattgctttggtcaaaaatcagtcagcaaagctcactctcccaagttgaaacaacttatggacaagaagttattgaaattaaatggtggcagacatgtcaaagggatattgcagggatttgatcactttacgaatcttgtgatagatgaatgtgtggagatggcaactagtgatcaacagaacaaaattggaaaggtagtaatatggaaatagtatcatcatgttagaagccttgtgacgagtataaacaatggctgttcagcagggaaatccatgccccctctccaaggggcctgttttatttttatgtaaaaattgggtcatttatgttttcatattaaacttttggttaaatatacttttatgatagtaaaacaaatcaattagtcatatatatttcctgcctctttcttctgttccagtgatttatatgtctgtctttttttttttttagacggagtctcactcttgtcgcccaggctggagtgcagtggcacgatcttggctcactgcaacctccgtctcccgggttcaagcaattctcctgcctcagcctcctgagcagctgggattacaggcgcccaccatcactcccggctaatttttgtacttttagtagagacagggtttcgtcgtggctggtctcaaacttctgacctcaggtgatctgcccacctcggcctcccaaagtgctgggattacaggcttgagccaccgcgcccggcctctatatgtctgtgtttgtgtcaataccttggtgttttgattactgtagctttaagtagtaagccttgaaatcaggcagtgcaatgctaccaactccgcttatctttcaaaaccgttttggctattttgaatcctttgcattttcatataaattttagaatctgcatgtgtatttcctcacaaaaagccctgatagtattttactaggagtttcattgagtatatagattaagctagagaaaaatcaacattcaatactggacattccaatctatgaacataatacgtatctgcatttatttaggtgttttataattttagtaacattttgtacttttcattgtagaagtcttatacatcttttttgtaagatattttctaaaatattttgtgattttggtgactttatacttagtatcactttaaatttaattttataattgttcattgccagtgtatacaaatacatttaatttttaatattgcttgtgtaccttgtgatctcgctaaattctagtagaaatctaattctactagatttttatgaagattccataggattttgtttttacatactcactgacgtcatctgtaaatagtgacaaatttgaaacttcttttccaatttagatgccatttgtttcgtcttcttgcctaaatgggctggcaagaacttctagttcactgttgaacacaagcggtgagagcaaacagccttcccctgttcccggggaaaggatttattgtttcaccattaagtatgatgctaactgtggcttgttttttaatgccttttaccaaattgaggaagctcccgtctatttctagttaggtgaatgttagcattctaatgatctgtatccttatatattttattccatcttcaaacatcttcatgtacatttttaacaaaagctaaaaagaaacaaacaagtaaacaaaaactgctgccaaagcactgaagctccccaagtgattccagaagtcagctaaagctgaggaatactcttaatggttctggtattattgagttccttgggaaagacatttctgagttggccttttcagagctgttgcccacctacacatggtattgtgtatttcagagtggaattcctcaatatttgttgcagaaaacaagccctgtcccaatccaggcttcttttcaaagaccaacttgttaaaaatgagtgaagggtaggtacaggcggagagcagccttcagaatgtcttgtgaattctctaagtttgtttggagctgaagtaggaatgagccatcatcccacttgtctttactggacagatcgtgatgcttaatgtggaatgcatgtgcccgtggattgacgagaaagctggtgtcaatgccagtcttcttccatgtgataatctttgttgtctgcatcatcctttgagcttgaccatctactggatgcaattgcaagggcaattcagataacccgttagttcactgacttgccgaatatcaactgaaaaaacctgattctttcactaggacacagcatcagaaactcttttatctagtgatctgtcaattgcaagcaagtatgattgtgccataaagatctattttgttgctgattgctcagagccaaagataattattttatttttcacacttttggattgcactcttgtaggaaggtgtggattacactgctgtatctctgtttgctgttttgtaatgttttcccccgtaaatctctagagtttggttctcttgcctctcccttgtctcctctcttgttaaggggagggaggacactgggttctgtcctgaaatccaggccactaagggatatatccctgaacttggacgttctcttctggatccctcatctccggtaaggcactggcatctgattccatgtgaataaggctgaggttctccttgccattcctgtcagaaagatcaagtcctatctatccagtcacccttttcttaccttccaccaggctcaaccattcacactaaacctctcacatagcttcactctgtccataagtccaaaacatgtatatctctcttatagtccagaaaggagcttgtaatcgatataaattatatagacataattacagacacaaatctacaatttcttgacgctgagacagactcaagggcttcctttgggggtcgcattttttgtagatgacattgtcctttaaggataagtgtttgctttctcagcactgatttcttaatgtaaagcagaagaaagtgtggtttgtgtttttaatgttctggcacgaattcagaactcagtacctgcttgatattctggaaggcatctctgtgatggtgaatttaaaatcatggaacaaattttttctagtgagctataaagtacttctgcagtagttcatatttattgaacaaaaatgtggtaaaaactgagtagcttgtaagcagtaaatatgggtgcttaggttcttatttgatgggtcactggtggcctctcaacatgttcctgcagttttaggtttggaacctttttgaagggagttggtgtagcccactggggttgccccactagtgtgaggcttcatttgtttattactttggttggttttcagtttttttctccttataattagacatacactttttagctttcaagtaaactgtgtaacgtctgaatccagataaaattagactggcttctatgtataaactcctagtgtctcagattatattttagaaaatttattgacaacttgtttattgaacttgcattattaccagtttattggatccggattcttaatagtatgagtcacttctttcccaagacacttttctaagctgtccccctgcctaggttgctgttgttctctacagcatttctaacaatatcagctatggtgttgatcattgcaatggaccacgtgaggaagtgttcactgttgactaactctcaagaaccgtagtattcctagctcaggcatgaccatttctgaggactactgcaatgtcctcctaccctgaagctattctttgtctagaccccttgagtaagataattttatagtcaagatcacatgaatattcacatccagtcaggaacattataatattgctgagtcttcaccctaatggcaggttcatttaaagtagcagttcctgagaaaatgtacacattgtacacttatttatagataaaactttagataccacacagccagagccagatttggctcatctccttgtattctcatgcatacattttctgcattctgctgactgtgggcaacagctttctgccagtgtaacatggacaaaattagtatgagaattctctttgttattgtgatgtgttagttattgtgtggtttcgctggctggggatattagttgggatgagttcagtcagattttattggtaatttcatatcagactttgccctgagtcatctaagaaatggaaaaaaatgaaatgctgaaggagatacacaggtctttaacataggcaacacagctcttggttccatttttgaaggaacatgctctcagcaatgtctgatattatggctgtgataatcagtggtgctactctcagtgaaataatgatgatggaaggtcttacttattaaaatacatgagtgggttccataaactgctcagggaccaccatttcttttgcacaaaggaaagtcatcaaggaaatcctggggcatatactgatcaacatcaaactcatcagtgtgtcccaaagtgctcattttaaaccaaaggatctatgtgagtaccaggatgaaggtcaggagtactgaaaatgagtttatctgccctttctggcccagttttcttctcaatacaatcccactctcggctctggaaaacagatggaagataagcctatacttccatgtagcccttcactggagagaaaacaattctaaccctaacttgttccaaaatattgaatatccatatatacaacacaggaattcaaaaggaacaaaatttcccaacattaatcaaaatggtccttggcatgcaaaattttttttagtttctaatctcatggtatttctttcatcctatcctgtagtcagtcatacatacccaacatttgagatctcagtagacggatgaaaattttagggtgatttttactatgtatttaaaataattagtaacaatgcttcctcttattttttccttaggggttacactgcagtcatagctgatgagatggtgtctttatttcccttcttagggtatttctggccatttctacaaatagaatcctaaccattggcctttcatcattcatcaattccttcgacactcttactgagctccgcctcctcattctcatgcactgtgctaggtgctggaggtaacaggatgagcaaaacaaggccctgcccttgaagaactcacagtgtaataggggagttagccttgtgcacaaccttgttttctactacttaggagccaacaactgagaggtgaccagaacacattattatttttttaaataagtggaggaaaatcattttcttttacagtaatagagttgaggaaagactgttccattttaggtccacacttgattttgaagagtcagaagaagacaattggggaaagttattacagttctgtatttttaaaataatggaatatattttcatcatgtatttcttaaatgatggaatcacttttgcttagcctttggtatttcatgttttatttatacattttataaatggccataaatgcaaaagcggagagaacaactgaatagtatgggctataaacccaaacttttcatttttgaggatttgaaacataatgtaaacatttgaatcaatttaaattctaaccacgttcatatataattctttttttaaaataaaaacatatatgtgtagattcttagatttgtatagacagaacagaagttaaggtagggcaagagaagcccaaagattatatgatacaatattccttttcaagaaaaataaaacagaaaaatacttggcaacagtagctaagcaacatattacagagcacattgattttgagaaaaaaagacctgttcattgttgtatgaaagactaaaacattttagaatactattatttaagattagtgtgttatatattgatgatacatcactgttttattcattcggtacttattttacctaaaagtctaagtttatcttcgaagttaatgaaaggggaaaagatcctattagaataaaagatcattttaaaagatgttcagaaatcagaaataccactgtttctctagagcagaacatactaaaagtgtaaattttcatattttctagcttagattgactaagtccctttgtctttacacaatgaacatttagatgtcatcacttttcattttcacacattaattgtttaaaattagttcactataaggctatcaattaagacaatatatagtataaacatcatcctggttttagttgcttttttttccctagaaatcctttaagctagtttatttttaagatgagaaattccattgcagtgattactcttctaaaacacatttggtctattttgttaagtagactaatgtcttccacacattgatcattctacaaactactaaaagctttattaatcatgtgttaaatttgttaaggaattttaaaagcttatgtaccctacatattcactattccatgtgatacttcaaaaaatgtgaaattggtttgataggtactattttctccattttatgtgtgaaaaaaaaaatgagcagttcaacgagttgcctgagactacccactggggatgtcaataatagaactgggagagttggtcacccaaccggtagagtagaaccctctgtgcttctgaatacagtagccacccccttatctgcaaggatatattctaagacccccagtggatgcccaaaaccttggatagtactgaactttatacatactatgatttttcctataccagtacacctatgatagtttaatccataaatcaggaatagtactcttgtgatgtgggatcattattaagtacgctaaaggttacttaaacacaagtgctgtaataccatgacagtggacctgatcatctagatggctattacacgactaatgggcaggcagcctaagccaaaaagaaaatatattggtttatgtaatgaggaagatcaaggaaaattctggctttagaaatgtctggattgtgcagtttgaatgttattatgacctttttctctggtttttggctttgctctcttcctccatgttggcaccattttaaggtaaatttttccgtgtgtcggcgaaaatgactataaacaattctagacttcattgtactttcaggtagtgagtcttaagagaagagagtatccttcaagtgtttaaacaaaaacctgaggaggttctgactggcctgacctgggtcatgtgcgcatccagaagtcccacatctgtggcaaggcagcatccacagaacatcatctctatgatagtggatgcagggttatgccagcgacatgtctaccagtagggagagcctgttgggataataaaaataagaaattcatattatgccatctataaaaatttttgcaaatatttgaagtgttggacaatatatagtattccattcaaagtgattggcataattttagaaaagtaaaattctatgaaattatggaaaattttaatacagagagtgcatactgcctgcctaataaggctaatctaacttgctgacctgttctatctgtcctattgatctgtagtgttttctgtttgttttcttttgtttttgttttttgacgaagttttgctctttctggagcaaaacttccaggctggagtgcaatggtgccatcttggctcactgcaacctctgcctcccgggttgaagtgattctcctgcctcagcctcccaagcagctgggattacaggcacgcaccaccatgcctggctaattttgtatttttagtagagatggggtttcaccatgttggccaggttggtctccaacttctgacctcaggtgatctgcctgccttggcctttcaaagtgttgaaattacaggtgtgggccactgtgctcggcctgttgctttttttaattgaactatattttagcttcttttaaaaacaaatcaatcttgacaatactgaaactacattcctgcgtggaaactatcagccatctcttttatgtggagcagcagcagctgttcccttcgatggttcatttgctctctcgttagccacaagcaccgtcactccctattgtctctaatgctgaggctgatttcacttgccccttgcacttgtttctcctagaatagagaattgctgccgtatactcatatctctactggatgcggaaaaaagaagcttaattcaggcacagtggaaaagagcatctttctttgacgaaataaagaatattcctccatgtgtaatatgcaaataaaagatgactatattgaaagaaccacagtttaagaggccagtatgaattaaatcataataatatgtctaggatatggagaaaatgagggaatgaagaacttagactgcaaaaaggactgaaatttcagcaagcaattgtttttaactatgaatgaaatatctgatgctaatataaattaggttctatattaactgaaaaaaatccccagatatcaaaagcttttacacataacaagtttatgaaagagcatcatagaatacagcagaaattgtgtgtctttcactgagataagcatttgtaaacttcagtttactggaaatactgttgacaagtatattgaagttacttctgaatacttacagacaagtcatatgaagacaattaaattggttgcagcatttctattgcagatgatgaaagcacatatataaataatatcacctagttagcaatatgtaatcggtgacattgatcagaatttttgtgtcagaaggtgagaggccctaactggaactcagcaaatgacttatctttgttgctagaaacgttttgcaaaatgcatcatcaattggtcaaaaccagtcactgtgactcacctcctgcaatgaatagtgttaatgtgaaaacctaaattcaagaaggctacattatccaagagacatagaatttagatctcctaattatgtcattttgcaggaagtgccttgtgccaaagaatttaaaaggtaatatagtatgaatgtgtggtaattgacaatgtgaacagaataaaatcccatggctgaaatccagatactccagggcttctttttatgaattacatatatggttgcctgtggtagtacatgaacttctgtggctgaatgctgtgagatatttctggacacttttatatcattcaagagaaaatccctaagcaatccctgacaatgaaaagtgaatcaaagtatttaattattttggctgatattagaacctatagactttcaatatttccctgcaaaggcattcacaaacagatgatgccttttgatatggtttggctgtgtccccatccaaatctcatcttgaattttaagccccataatccccatgtgtcatgggagggacccagtgtgaggcaatcggatcatgagggtggtttcccccatgctggtctcatgatagtgactgagttctcaggagatctgatggttttacaagcatctggcatttcccctgctggcactcattctctttcctgctgccctgtgaagaggtgccttttaccctgatcataagtttcctgaggcttccccagccatttggaactgtgagtcaattaaaactcttttctttataaattacctagtctcgggtgagaacagactaatacaccttatagaaactaatttggcaagaaataacttggcccagtagcctatactacaatcattttcctcaaatgagagtcatagcctgaactacattaccaaaactgtagagattaaaacaaaattccaaaaggtttctctgacttccagctttatgaaaatacattaacactgcttaagtttacctttctagtttattattgatactatgaacaaaggggctacaaattgaagtttttaaatgcaaagcaatgaataactaaaaactaaatacattgctgttgaaattccagagctgaacatatatctctagataatgatgattgtacaaacagagcctatacatgttaaatagcatcaatgttagtctactctgtttttgcacatgaaactaggccaatcaaattattgttccaagctgaataatttgtggtttaggtttcatggcctgacagtgatgtctaatgatagattacaatggcaaggagtaacatattgtgaaagaaaacttcaataatgaaatacttctattttttcaatattgtttttactttaaaatgtcaaatatctctctgtcatatgtttgtgttatgttacatgcttttgtcattattcaaaaaacatacagtatttttaaaaatttcaatagcttttggggtacaagtggttatgagttgtatgaattatatcgtggtgtattctgagattttagtgcacctgtcacctgagtcgtgtatgttgtacccaatatatagtacttttatcccacactcccttcctaccctcccacttctgagtctccaaagtccattatatcactctgtatgtctttgcatattcatagcttagctgccacttataaatgagaacatacagatcataaagtaattttggttgttttctggcacttaactaaactgacatctaatctgcctcactgatttatgtgattggctggcttctgtaggcatttgaatgagtgacctctgccttgacctaagcctctatatggtgctctgtcatcctttgatgaaagactatattaaacagaataatctatatgattttcataaatagagagtccaaagagtaagaatttgtcagagtgtctccagcactgtctagaggaaaaatgtatgcagaccaagggcctcaaggatattgttactgtggagagagatgcattatcttttcctagactgataacagtgactataaatgtcatttaactagctgtccttgatcagatgagacactcaccaagcaacaggaacattcctgatctggccttaggagagaccgtaattaccaggcaccagagtatcttgtctcttcagaagtgaatcttttccttatacattgtcacattttctttctgccttatgtagcagcttcttgtcagtttgggtaactaaataagtcactagagacttatcactcttgggcatcctgacaaagtatcttgacctctaaacaatggaccagatcttgctacttgtttatatttatatttataactcagtgttctaaaaacagttagaccatacccactactgttcagctgaaatgatgtatgagtatttgggaataatagtgagaggctcccttactacaataatttagaaataaaattactattacttttactttgaaagtaaaagaaaatatttcttatgtgaataaaataagttaacttaagcaatggtgaatacatttggagaaattttgggactcttcaaagtgctcatcaaagttgctagtaggtaattcaaagaaaagatagtttctactgatacattttttaaatttattttaatctaatctagtggcattccatcttgaaaaatttacccagtaggctagctgaatatttaatggacgtctacatgagagtagattaggccaagcctagagtgctcatgctttcaacctcggcctgtggctgctagcgctttgctaggtaaggcaaagacaaggtggttaatggccccgataggctttttcacaataaattaattaatgtgggtttacattcttctcagaggcgaataggcattctctgacatgcacccattaatgtaagttatgagacaaagtattttaattatatatcatgccacgtaaggctttataacttgtaccaactccgtcaatattgaagtcaataaaagttgagtgactgcgaaataagattctgaacaattaatcttaaggctaaaatagtatgaaaagtgaatagaaattatagatgtatgtaagtttattatattagtccaataattaaaatttcctttaaaaaagtccatcatgactatattgaaaaaagtttgtgtctgccctttagaaataattttaaatatactctgttggctttttctaactcattgaatcctcagacatgttttaagcaaattaattaagagtgtttgttctaagaactactgttgggaaatgatagtatataatagagatacatttctgcaagagaaaacaaacattaaactgagatgtcaatgaatgagaaaatcagacagtcctttttaaaaatccttactgtagtgatagtcttaataaaaccacaaagcatttgttggaaagaactgaatcttgaaggtcatgtagtttaactttctacccgatgaataaatctctcttacgtcatcccaaatagtcatatagcctctccttgaacattgcctatgacattggatttattacctttctacttggttcataaattttaccttctatccagctttagagttctttatttactaatatatgccatacaacttctactagactgtagtctccctgagggaggaatctatatttaaatccctaaagccctgtttacaaccagtgatgtccctatgataatattactgaaataataagttctagtttgggaacattcttcctattagaagatttctttttaaattgagccctttatcttctatcaactgatccaattccattcttaggagtctctcagcccaagggtgggacttcctcctttaaggtgaagcttacaatctttggctccttgttattgctttcattatccctttcacaatgtgggaaagagctgatctgtttctgtcatttcaaaataactggtattcatgacacagcaaggtctcagattttactggacaaaactcatccctttactcatcaagacacactgattctttagttaatttagttgcaattcaagtcagtctctattcctaaaattgcctaaggatatcctactccaagagagaagcttctttctgggtggttccaagagtcgccacctgattatgatgaacactgagacagcacaggtcacaggaaataatcccattttcaggtagttttgtggttatgtcatcagcctcattgtgaggtaggaagccaaaatggccaatttctttttctcagaaaagtttactcgaatatctatgaaagatatccttaaaatttaaagcatagactgttttacaaccacaaaagactatataccaccaatttcgacttcctcactttgtagacaagggagtcaaaactcagagtgtttgtcctaagccaggcatggtggcatgtgcctgtagtctcagctactcaggaggctgaggcgggaggacctgtgaacaatgtctgtgatgcctcattgagaagagagaagcctgggccagcaatgatgtttcaggcaaaagaggaagttctgagtgtggacgttgacagtgagtctgacaggagggaatgaatgagggagacgccattgaggaagcatcaacagggcctggctcactcatagaacgagggtggcagggaccttaagggtatcaaaaatgatgggaatgtttccagctcatgactcaaataatagcagttctaataacaggaacagggaaggcatgaagaagagctctttggagttcaggggttcaggtccagactgggcaacatagtgagactctgtctgttaaagataaactttaaaaaatagtgtattgtcctagatcatgggagtactggaagtatcagaagtggagaccaagaccccttatttctctttatctctatttccaaagagctcttttctcacgccactctcctcagatgtcaaattggattgtgttttctgtgtcatgtcctgtcatgtaaaatttaaatattaaaatctgccagagggaaataagtgcttttaaaggtattttgtgatttatcacgtaaagaacttaaggatatgtgttaaataaacctgaaataacatgtcattctatttcagccctctctcatgaaaagagaaaacctagttgtcttcgaattatcctgtattagtccattcccacactgctataaggaactacctgagactgggtaattaatgaagaaaccaggtttattgacttacagttccacaggctgtaagcatggctggggaggcctcaggaaacttaaaatcatgtcaggaggacaaagtggaaacaagcacatacatcttcacatgcaacaagagagagaaagcaaaggcggaagttctacacactttagacagctagatcttgtgagaactcactcactcactatcagagtgagcagggggaaatcggtccccatgatccaatcacctcccaccaggtccctcctccaacactgaggatcataatttaacatgagatttgaatggggacacacagctaaagcatatcataccctcaaatcttcttttcttcagaaaatttaaattcttttaaattgaagtagccattttggaaagacagaagcataagtaaataatattgaactaggtgatgagataatccagtatttggcctgattaaaggtaaatatttgtcagttccaacattgaatacttggcattatttgttgtgggaatatttatttattatattggaatataataacttttaatatatataatacactaaatacataatatataattaatattataatatataatattaatatattatagttgaatattttatattatgcaatgtttattatatatttattatatgtcaatattttaatatatcagagagaacaatacatataatctttggagttcagaaaaagtgaaataggcctgaagttcatttcttagaaggtgcctagatatactagaaacatgaagaatgaaattaataaactcgtaggatgacttcttcctttgccatgaatcgttgagggttgtaattatacaaatttggactcacagacaagtacttttacattttgaaatgtttcaccaaataaatattagtttatttattaatatttatttaagtttctttctttttctctctcccactcatttatttgttacagtatttgttcaaaaagtacaaaatgtccacgtgacaggccccttacctggtactaagtaatataaacatgactatgaaacattgatttccttaatctcaaggaggcaaccctccttggagcagtccatcatgtgactaattatcatgcaatagcgtcagagtgagacatatgtctaaagtgtgggtgagccaagagtaagtgataatttccagtttaggggttgaggatgattttacagagtaggtaataaatgaacgcaagcttacctggtagggaatagggagggaaaggtgttgcagaaatagcacaagttaaggcatggaggtataggcacaactagtttgttggcagtgctctaagtcagaggtcctcaaccctcaggccacggacaggtaactggtccatagactgttaggaactgggctgcacagcaggaggtgggcagcagatgtgcgagcgaagcttcatctgtatttacagccgttccccatcgcttgcattactgcccaagctccgcctactctgagatcactggccgcattaggttctcataggaacacaaaccgtactgtgaactgcgcctgtgagggatctaggttgcgtgtcccaggagaatctaaagccagatgacctgtcactgtttcccatcacccctacatgggacccttgttgcaagaaaacaagctcagggctcccactgattctaaattaatgcgagttgtagaattatctcattatatattacaatgtaataataatagaaataaagtatgcaataaatgtaatgtccttgaatcatcccaaagccatcctcccaccccatcccgtggaaaaactgtcttccataaaactgatccctggtgccaaaatggttggggactgctgttctaagtggttcagcttgaagggtgcttaaagtggggaagtggtaaaagaagcacgtgggggcagtttgctaaaggccctgcaggaatgctaaggagtttagattttatctcctagaaaaatgatcagatctgtgttctagaaaaaacctgtaccaacaagcatacaaatgtatgctcttggctttcaagcttacaatttagttaaagggggtaaaaaataagtaatataatgtttaagttataaaagattaaaaataaaaaaatgcagtgagtgttcagaaactagagaaatcttaaccaactgaggatgatcagaaaaaatatttatgaaagagattgttcacatttgaactggggcttgaatttatgacgggggtgtagatatatatagaaaaaggcgaggaaggaccgtcaaagtagaagaaacagcacgcccaacactcagcaggtggacaggagcaacatgggtgaagggcatggactttacagctcagatggttgaccaaggagaagacaagaaagtccttgatctaagttaagtaatttgagctttattcaatagggacattcgaggagagtgtgatcagagatgtgattccagatggtttacctgggaacaatatctgtgatgcctcattgagaagagagaagcctgggccagcaacgatgtttcaggcataagaggaagatctgagtgtggatgttgacagtgagtctgacaggagggaatgaatgaaggagacaccattgaaggaggatcaacagggcctggctcgactcatggaatgagggaggcagggactttaagggtgtcaaagatgatgtgaatgtttccagcttgtgactcaaataatagcagttctaataacaggaacagggaaggcatgaagaagagctctttggagagaaaagcatttcttaagatttggatatgatgactttatgcttcagataaagtatctgaaaggcccagaatgtattggcaatgctgggctgggagttttggaaagagaatggattttgtgatgaacttttaaaagctattgttaactcctgtatgggacatttttcaggcagaactacaacgattgcagcaagcatttatggattcactagtatctgacactcattaaatacaattgttaaagtatgggtcttcatctctcagaatgataatctctctagggtaagaatttccttggatgctatgagatcaatgaaatctaatgctatctttttctttcaacaaatattgaccaagtgcctgtgatgatagacctattgctatgtgctgggggcccagagatgaacaaaacccagcttgtctcagaatagttcgatctggaggaggagagtaaaatgtaaatacctaacaattctataatatcctaagtgttataagagagtcattataaattgctgtaaaaacacagaaaaggatgtggtttttaaaaatatcctatattatcattgtaggtctttgtactttttaatttaaaaatgcttattaagtacctactaagtcccagacattgtgcttgtcacttgggatgcagatataaataacatgtagtcttctgagagctcctactgatgaatgtattaaatgttattcatacttatcttacaggtatggctgaaaacattgattcttgaggtgttgcttggaaaaaaaaacagccagttgtaactagtgaagctttcagagggtgatttttctatagtgtgggcactcacagcgtgtccagcacactgcttggtgctgttgaatagttaattctctaattactgcaggtctgcatgccagtgtggactggctgccatgaataccaggaaaggtttcaaccaaataaaacatccaggacttggaagtactcttgttcataatctcttctttgtctaattcttgcataatgtaacaaagtttttatgaaaaggctgtgcctcataaatgttggaaattttaatattataatagtcagaaacaaaaagttaggaaaaactaagaaataatgttagctattttctatgagcgtttaaaaattgagaaactgactaagaatatctgtagattgaattgctcatcactttaagttaacatagtagccaaaatggcaagtttctattacgttaaagtatatcatgaagcctatgtacaatcatgtaaggttatatttagctatatgtgaacatcaatttgcccatacacccattaacatagttgaacaatgacagcaccaaaaaattaacaggtaatatagtacttactatgtccaggtgctattcagacaataaataattcaatcatcttatttagcatatgagctaggaaccacgatcatccccattttacaggtaaggaaaggaatagtgaggcttactagcccaaggtcacactgctaataagtggcagaggcagaatttggacccagcattcgggctctgaaaacaataatgataactcccatattatactgccacacagataagaggaaaagattagctatgtttgttattgaactcggaacatcttatagcagggtctgtttgtattaattgggatgcttacacacagaaatgagttagggaaaaatattctgaaagtgcctaatcctggtttggaaaaaaaaaattaccttttaaatgcttattatctaacaccttgtaaccttaaagtaactttcaagagtgactcagtttgtgcttaaccaaaatattactaataatgaaacagcaaaaccttggaagtttccattgccaatcataagatgtaaggcacaccccgataattttatttactttgcagagcataaggtggaataacatgttcttttaaacgtagagtttaaacattgagttgcatcattgtgaggaaaaccacttagtattttatagtgaggtgactttacaagtaaagatcttcaagaagatttttatgtgatttaaaaaatcagcttagatgcttggaatttggattgttgcattcttgttctttggcacatcaagaggtaagattcataatttataataagttctttaaaaataatgagtatacttacatctaaaatgtaattgacatgaacttattctttagaaattactattgctaatttcattcttaagtagtttattgtttttatgaatatgtttaaaatattggctgcttatatttctttgtatttatttattttttcacttaacataaaattatcaatggaaaatgcatcacttaatactgaatgagtcttatgaacataaagaagcatctatttccaacaatataaaagagttgccggacagtcttgtgttgggctgctagctctgccacttactagtcttatgggcttagacattgaagtctcaatttcttcatttctaagaagggtacatagtaataaatgagaaaatatatacaaatttccaaattctgtagctgactcatagtagatactcaataattgaatgaattaactaattattaatgtcagttggaatgtccattttttttccacttcagtcacagttttctggagggctgttagtctgtggacatttcttaaacattaactcagtattcattgacatgtttgctctttatactatggactccttagacattacaatgtaaggagttagtgattttggctacttttaccatccatgtttaatattgtgcctataagcaaacattaaaattagttgatttattttaaccaaactagaatcaaataattttaatgttgaaagagatcaacccctttgttgtaaagtatcacgtagttggttgagatagtatggtggtaagaagacagtcgtcacatctaacattcagttcaaccaccggtttgaattctgaatcttcttgggttttagtcctcgttctgctgcttggtagttgcttaactttaaacaagtacttaacctttctaagcccagatgattgatctgtagaaacaggacagtaaccaaaataaaattatagggttgtgccaattaaataagatgcaagttgaccatctcgaatccaaaaatctaaaatctaaacttctccaaaatctgaaacattttaagcactaacatgatgccacaagcagaatatttcacatacaaatacttaaaacaaactttgtttcatgcataaaattattaaaatactgtataaaattacctttagcctatgtgtataaggtatatatgaaacataaatgaattttgtgttaagacttggaccctgtccccaagatatcttattgtgtatatgcaaacattccaaaacacaaaatctgaaacacttctggtcccaagcgttttggataagggatactcaatctgcaattcatgtaaaatgcttggcatgggatttgggacatattagtagtgagcaatcaataaatgttcgctcttatttacacagatgaagaaaacaaaacacagagagattcgttgtgtaacatcttggcgctagcttgtggaattggccaatcttgactttcagttcagtgtttttcagtccctggcctccagctcttctctattggataaaaaatgaaggagataggactatcattagttttcatatttcaagaactatattctattttgcatgattctcctgccccaggacagtcctaattgagtgctgaaagcagttagactggtgaaggcagaattaagaaataggcagtttgccctgatctgctgagatgatatttaaagccatgactacagacaggatcatcaagggagtgactgcaggtagagaaggaagatggaactactgagtcctaggacacttcctcattaagaaatcaggaagatgaaggcaaactagcaaacaagactgccaagaagtactcagtgaagtggtaggaaacctaggagagtcagcatcctagaagtcaatttaagatgaaagaaataacagcatgtttgtgtgaggctaggaatgatccagcagagaggaggaaagttggtaaagcaggagaaagagaagggagtaatgttgtgccttacccctcagtaggtgagagaagatggagtcttaataggatgaaggtttgcctttgcgagaaacaaagacagttcatctcttgtgaacagagtgaaggcaaaatagaagggcagatatctgcaggtagctggatagacacgctgggagcttgtaaaaggtctcttctctttgtttctggtttcctattgaaataggaaacagggtcatcagccaagaggtttggtgggcatgaagatgttggaggtttgagaggcaagaagaatgaaataacccaggagtctgggaaaatgaagggcctaggaaaatatgatatgatggctgggtagctttaagatctgctttaatttcataaccacaaattaaaagtgagatagtcagtacggtatgtgatttcctccaggcacattcagctgcacaggtgtagacaggaaataggtgaagtgttgggtttaaccagagttgtggttaagccaagtgaagcaagaacaggagagaagttcaaggagagtacaggggtatggttttaattgactgtaggatttacactggataagaagggaattgaggagagaaatgtctgcctaataagaagttattttaacaaaatacatacttatgtaaaatttagataatacatatatttctcctacacaccacatatctattacacaactgccataaatttaacaattgagcttacattcatttgtattattacctatatctcatctattaaatctgtaacagagtccattgccttcaatcttctggtacctaccatttatgctaatgacttccaaatgtaatctctccagctgaacttctccctggaatcccagtctcgtatatgcaaggtagctccacttaggtatctaattcatatagaatctacatatccaaaactgaactctcaatatctacccccaaatctgttcgtctcaaagttttcacaattaatggccttccagatgctctggccaaaacaccttgcatcatccttgacttttctttctgtcatacctcactgccaatcagtcagcacaactctttggatcctccctcaaaatccatgcagaacctgaccacttgtaaccacaccactgctaccaccctagtcttagccaccactgacttttatctagtttgttataatagtctcctaactggcctcttcctctaccttgcccagaagctaacccaagtcagtccatgtcacttttctgctcagagccctccagtggcttcccatctcacttcagagtaagagccagtgaactaccaaatgctacatgctttagccctctgttacctcctagcattaacccctgctcctcatccacctacccctattcaaactcctgggggccagatgcattacaaatgttagggttttttttattattttgaaacatgctatggtaaacatactgtatataatacataatttccagaaaaatctaggacagaaccccatatttaatcacatgcatatttatgtagtaaaatacatgactacgatcccacataatttaatctcatattaaatgggataaagactataaacagctttaggtctgttattgctgccaaactagttactgcaaactagaaaacaaataaatgaacaagcccaaaagcaactatttttccccagagatttttagattttgaaattgcagagtaagtcattgtggagctatgtcttctccctgtctccattccctgggccctagtcccggtgcctcctcattcctcagtcacagtaggctctctgcttccttgcagagtcttgtgctttccttccctctgtctggaatgctgtcccacacatctgcatgcggtttgctcctctcccccccaggtcttgatgcaaatgctaccctggacaccctatttaaactgcaaacccctcctcacctaaacacacaaacaccctcatcccttccctgctttaggttcctcctagcacctgtcactgttttaatgtagccatttttgaaaaacgtattcttatttattgtctgtctctacatcccctaactagattatatactccatgagggctagaattgttttctccaatgctgaattccagtgctaatagcatctggcaaataataggcacaaacaaatatttcttgaatagattatcgaacctactttccagcttttctatgtctttggaaaagcctgctcacagtaagatagagaagtgactcctttagagagtggaaattaggaagataagaactaatatgccaatttacatgatttcttaaccaattaacactagcttcatgtaatgtgctgtttttcaaatgtttctttaaagaattcttaggccaaaggggaaataaagcatttcaactagagaatatattaaaatacaatgactcaagaactgaagaaagtggaaaataaaataagtaaaggtgaagaaagcatttaagtaataaaaataaaaatataagtagaagtgaatcatacaaacaggaaagatagaattcataaacctatgtggcagttgcttaataaaactaatgatgccatgatggcaaatttaaataaagtgaaataacctcagatgtggatgaagttaaaatgactagactttgcataaatttatggtaaaagaattgaaattctagatgaaagtcttactacttacaccagaataaatcccaggtgggtaaacattcaaaagtaaaagataaaacattagaaagaagtatgaaagaaaagtgtgtaattgttaatagtcttggagtggccaggcacggtggctcatgcctgtaatcccagcactttgggaggtcgaggcgggcggatcacgaggtcaggagatccagactagcttggctaacatggtgaaaccctgtttctactaaaaatacaaaaaattagccaggtgtggaggtgcacacctgtaatcccagctacgcgggaggctgaagcaggagaatcgcttgaacctgggaagcggaggttgcagtgagctgagatcgtgccattgcactccagcttgagcaacaagagtaaaactccatctcaaaaaaaaaaaaaaaaaaaaaaaaaaaaaaaagtcttggagtgaggaagccttttccaaacaaaacaaaaccccaaagccactaagcaaaagcctgataattttgattgcataaatgcaaaatttctaaatgacaaaagtaaagtaaaacaaaaatatagacaacaaatttgagtatattttccagatatctgactaaaaggaagcaaatttctctactctttgaagagtttttacaaataaataagcaaaaacaaactttagaaaaatatgcataggacacaaagatctcatccacaaaagaggtacaaatggctagaaatgcacaaaaggatattcaaagtttctgataattaaataaatgcaaattaaaataacaacgggttttcattcttgtaggacatgtaaggttgtcatactggtggtacttacagaaactgaaatctacatacccttccatagtatgtagattgtattgttgttccccatattgactctccatccctttaagaccattatacacattcatctttgaccacatgacatggaagagagtattctaagtctagacacctttaagagcctttgcatggttccacagttgcatcattttcctttgccccaacagacacaggctcaaaacagagcctactcatttagcttggatcctgcaatgcagaaggctggtaaatcagagctaggcccaacctaaaaccactgcagccaaaggataacatgagcaagaaataaaccttaatttttgtaagccagtgagatgtgaggggctgtttattaccataaagtaacctagcaaaagctaggctatatctcccaattccacttagtgatagagtgaccggcataagggttcaattattttcctgccacaaatagcaatacatttctcttagatcatcactttttctaagtcttcattttttcacatgtatgacacataaggctaaatctgtttttggtattttttattagcagtagtaagacaaaaagaaaaaaccagactgggcatcatttggtaaagaagtactctttctctccttttgtgacctttttattattataaaggtaattcatatttattactgaaaatttgataacatagacaagtataaataagaaaattaaaaccactgggattcaccattaatattttggtacctttcttttaattttacttttttccattacagatattattacaaattctctataaacatttttaatggctgcataatattcctcaataccataattttaaaactatatcctttattattggccacttaagttattgacccaatttcaatgtattaactttatagcaaacattatttttacagaactattaatctttcaatcttttcttaagtggctttaataccttataatattgctcactgtgctttatcacatccattttcctttaactttacactctctgtgagcattttcttatggaaaaaagagcacagtggtagataaccctggtaagcgataaacatagaaaataaggactagttataaaaatcttcattttaaaatccatagactgaataatgtagttgaggacctggagaaaaaagcaacagaatgcaaaaaataagggcaactgggcattctagggaaaacagaaggctgttttagaaagccatgatccaactatgaagtcactggttcaaattagaaaaggatcagaatggattccaggcaggagaaatattaagaagctgcaatataataggaatatattgaagaaggcacatgttcattcttccaggaagagaaaaaaaggcaaccagagaatataggaaaacacaaacagtacaagagaggcatgatccaaatatggagtaacctacgatgacactgatcctgagtaattcaaatattaggaaagacaattcatttgaatcatctcctttgaagagaatgagtgtctgaacaatggaagtgcagtaaaggaaatgtaattatagcatgcgagttgattgaagccaaaaatatttatctagttataataatataaattctgttcattgattttcaactttttggagtcagcatgcagacaaaacatagaaggattaattttgcttatagagcaaagtctgaatattatcaattttgatagtatgaaaacaacattatgaagctgacagaccttggaagctggaagggaggaagagagggagagtcagtacctctaaaatcttcctcttaggaaactgggagtcaggttctaatgaatatgttgtatggatcaaaaaatagaaggttactgtttaaatttataatagaagccaataaatgagccaaaaaaaaaaaaaccaaccaaacaaaaaacaaaacagtgtattgaccgcattggaggaagaggtgagacaaagtgaagagtgggatgcgctgggttattgagctgttatctctcggcttcaagcctgcccttctggctgagctttgctgaggctggaatgtggccagtaccatcctaacaagtgtgggatgatatctcattaaggttttggtttacatttccatagtgattcacgatgttgagcatcttttcatatggctgttggccatttgtatgcttcttaaggaaaatgtctgtccaggtctttgcctattttaaaatttagttatttgctttttgctattaagttgtgtgagttccttaggtaatttttttacagaaatagagaaaacaatcctaaagttgttgtggaaccacaaaagactccaaataacaaagcaatcttaagaaagaagaacaaagctggaagcagcacacttcctgattcaaaactatatttactacaaaattatattaatcaagacagtgtgatactgacataaaaacagacacataaacaaatggaacagagtagagcgtgcagaaatacacccatgtgtatatggtcaactagtctttgacaagggtgccaagaatatgcaatgaggaaatgattggcttattcaccaaatggtgttgggaaaattggatatccacattcaaaagaataaaattgaacccttacgccatatacaaaattataaacctgtgtgtatatggtcagctagtctttgacaagggtgccaagaatataacaatgaggaaatgataggtttgttcaacaaatggtattgggaatattggatatccacatacaaaagaatgaaattgaacccttaccttatgccatatacaaaattaacttggaataaagacttaaatgtaagacttgaaattataaaactcctatgagaaaacatacgaaaaatctccttgttgctggctttagcaatgatcattttggaatatgacaacaaaagcacaggcaacgaaataaaataaataaacaagtgggattgcattaaacaaaaaagcttctgcacagtaaaggaactagtcaacaaaatgaaaaggcaaccctatagaataggagaaaatattttcaagccataaatccaataaggggttaatttccaaaattaaattctactttaactcatagtgagaaacacagcctctctctaagcctggttcctctatactgacactccacctttctgctgcaggaaaagaagtttgctatgaaaggttagggtgtttcaaagatggtttaccatggaccaggactttctcaacagagttggtaggtttaccctggtctccagagaagataaacactcgtttcctgctctacactatacacaatcccaatgcctatcaggtaagctaacttgcagccttcacacatggattattctaaaatataagatttgcctatagatacagaagacatagatacagtaacctattctgacatatgctattgacttaaatgcaaacatttcttttcagtattatgagtcagattttttctatgttatctgttctatattatctgttctgatatatctgatttaaatatgaagattgctcttatgttatttcataacaggtaaacttgatattatgttcagtcaatgtaccaactgagaaccttccatctgtaagactgaataagcaacaatgcctattgtctattgaattgaataaacagaacagtcttgactttattgcagtgggagaaatgacatgtacaaacaaatacctttcttgcaacacaaattatgatctgtgatgtaagatgcaactgaaagactctgggaacaaagtgaagaagagctcaccttgaggtcagggatggaaccaggtaacattttgaggaggacatgtatttgaggtgtatcctgcaggatgggcaaagtgctcacaagcagagataagcagggtaatggcaaaggaagtggcatgaacataaaggagagaaaccacaggcctgtctgatgaatgacgtgttgggttagtctgtgggcagagaaggagtcttcaaaagtaaggttagttagaaaagtagttgaggaacaaattgtatagttccttcctgtggagtttgtacttcatcctgtaagccatggggccccattgagagcttttcagagatgctttagggcatttactctggctgctgttgctctcttgtctgaagctggaagagactagaggtgactatgaggccatttagaactgtgctgtccaacatagtagccactagccacatgtgactattaaaattacaattaaataaaattaaaaactcaattcatcagccacaccagccacatttcaagtgctcaatagccacatgtggctagtggctaccatactggacattacagatatagaatatttccgtcatcacagaaaggtccatttgacaatgttaaatagaaagctatagtgcagtttggatcacacacgggaaacagcctgaactgcagtaatgaaagtggttatgataatagaaaatcaacatgatagacatcataaactagtctgagatttcacacgtaaatgattgggaaaatgataaccctcttatcagaaaaattgaggataaaagagaaggagttagattctggataggtggggcttgagcaggctgttggagatgttagtctaacagcgaagcaggcagcccagagctggagaaaaagattcaaaagtcttctggctggggttgcaaattgaaacccaaagagtacatgaaatctcagaagcagagaaacgagggcaggactaggagtggttggaggatctatatttagggagcaggaaaaaagtggggccagagaagatcatttccagtctttacctgaatctgtaacctcagggcttactttccatcaggcccatcacatactgctgggccttgccagccagggcagtcttctcctatgcactcctaccgtacaaatatggtctgatttgtagctctctactcaccagacacacatacatatgtacacactactctttactgaaatctgccagctatctgtagatgagtatttccctaaataatgttcttcacaccttctccacttccctccatttggaaagaatcatgtgtagttaaaccagatctgtacctgaattttgtaatggatagaagcctgattgtttgctgttaaagtgtttttcaacaaccaagatataggataaatcaaggtatgtacttaaaacaaggatttccacaggcctgacccatatgttatatgagtttgaccaattctgtagatgtggctgtctctagaacaaggaaaaaagttcttactatgggtatagagacacttataaagaaacattcctcaaaagcttgagttttataattatcaagaagtaaagagaggaatattacttagctttaaaaagaagtgaaatgccaatacataatataacatggatgaccattcaaaacattttgctaataagccagacacaaaaggacaaataatctatggtttcatttataggagatatctggagcaggtaatggagagttcctgtttaatgggtacagaattttagtttggggtgaaaacagttctggagaaagatggtagtgatagctgcatgacaatgtgaatgacttaatgccactgagtttgcactttaaaatggttaaaatgttgattttaatgttatgtatattttgacttcttttgcattttcatttttaaaatgtttggaaatacgtacaactttcatacagtttcagggtgctccagacacccgtggccacttcttgtaaaccactgactatttctagagcactttgagagactacaatatgatcatgatcaaattttgtaattaaacctaatgagggcaacagacacttctcagataagaaatgtgtcaattacagagctcccctactctaagtattcacaaggagacagataaatagtttctttattcctcctcctcctcctattcttcctccccgtcttcttcatcctcctcttccacttttttccgggcaactttagcaggacgctttgcgccatcaaactttactttcgacttatagtcagcaacatccttctcatactttttcagctttgccaccttagtgatgtaaggctgctttttcgctgccatttaagttattccacatctcacccagcttttttgccacgtctccaatagagaagccagggtttgtggatttgatctaggcgcagaattctgaacagaacaggaagaatccagacggtggccttttaggggcattaggatccttcttcttgcctcccttagctggttcataatccttcatttcccgatcatagcgcactttaatcacctttgccatttcatcaaatttagatttctctttcccggacattatcttccacctctcagagcgcttcttggaaaattctgcaaaattgacagggacctctgggtttttcttcttatgttcttctctgcacgtctgcacgaagaaggcataagcagacatcttgccgtttggtttctaggggtcacctttagccatcctgactgtattgttcgctagtagatcaacttttttttaagtgaagagaatctatgtagaatacaagtatttgggggcaccttctctgccttttaggatgttcagggcatatttatccacttaggactaactctattccctgatcttcactcttaggactcatcaggctcattgatccttttatccttttatataagtggccatgcacttgaattctgtggagcacggtcagtaaaacagaaggtgataaagacagtgtttaggtgaagctgggtcctactgccaatgaagagaaaattggaaaactaagtacttccctaaataatgttcttcacaccttccccacttccctccatttggaaagaatcatgtgtaattaaaccagatatgtatctgaattttgtaatggatggaagcctattgtttgctgttaaagtgtttttctaacaactgtgatataggatgagtcaaggtgtgtaattaaaataaggatttccacaggcctgactcatatgctatatgaattggactcatttataaacaaatcagaaattaactctacacagttaacatactctcttctccaagtgaggaattgtcaaaggtaaatgtggtgtggtacgataaacttggtcttctggaggtcacaggtctttacagttacctttctgtaagaataaaaccaaccgacttcccccatgaatccatgacaccttaacctagagtgacttatacagtcactggtggtgatggacatgttgcacacttccggtagtttctgtgtctgcagctttagtcaaggatagaacatacctaactggtaactattttttacttgctagagatgatatcactggaaatgtagtcatcagaatggattgatctcgtacctattatgcttcatgtctgctcagtcaaagaatgctaaaaggcccagataaaccttgatactttaattaacccttcctctcgataacctattctgtacaatattgacatcatttcctcgtttctatccttgtggcagcagaatctaagctgtcttcttttgatcccatgatggtgtatggagtttcccacatttatgttgaaaagctgctttagagggttgtgccagagtgaatgtgaaagtgttttctctacctattctacttgattaaactcctcattgatgtcagacaagatcacccatatcagcatacctggatggaaaacagatggcagatggcagggagacatgtgcaatgtatgatgtgaataaactcctttttacactagcatgacaacagatgctcagaccccacaatgcctgtcagaatgctattctcatgttgagaaaagaataaacaatttttttcggactaaattccctccaaaaggtttttcagatgtagaaatgggactatagtaggtgtttgaggcgctccagctgggcctaagagagttgaaatgagtgagcacctggattatcttagagacatagatggaatcatgtttttgtacttggattggattatttagcagaaaaatgcttcctagaaggcctgaagatgattgattttattgctcacttcagcaaatcccacatctggtttgggccctatcagcagagaacactataatcagaacatcgcttgagagcccagtggttaagcacctaacttcaaaggccatgtggatttgaactctggctccaggattcattagctgcagtactttttggcaagttacttggcccctcagagtccccttttctaatttttaaaattagtacctacttcacagtgttttgagagttaaatgagctactctataaagtgcttagaacaatgcctggcaaatagacagataggagtgttagctattataattactgagcaagccaacttatgactctcataaccattagcttacagtcttggagacactttacctagccagcaaattgtatgattaattgcattactattaaacacaggtagccagaaataggctctttgtttgaatttcataaatatctaaatgtgttgcttccaggttataggattcaccactgtcagacttgctatttgctgatttaagtattcattttttccaatagaattgcttatacttgtgccttttattgttttaaataacaaaatcacttaaatttatagtctcctaaagtctttgagagttttgttattaaggcaatccaacaaaatacaagaaatacaaaagaatatttgacataatcatataaaattatctccaatatgctggtgtatttcatgtgatgagattctaacctcaattccttactcataaagtggggtggacaacctccattttgccatgtttttggcatgcttctaggcatgttttaattctcatgaattacactgatcactgagaaatgttatacaaaaataagatttactgaaactatgatttaaacttcccaacattgtcttgcaaacattactttaaaaatcaaagattttttcctcgtgttgaattcgtatactgcattttataatgcattaactttttgagctagatgtggtggctcgtgcctataatcccagcaacttgggaggctgaggtaggaagatcacttgaggccaggagttcaagatcaccctaggcaacatagtgagaccctgtctctaaaaaaattgtttaaaattagccatgtgtggtgtcatgggtctgtaatccaactattcaggaggctgaggcggccagatggcttgagcccaggagtttgcaactgcagtgcgttatgatggagtcattgcacttcagcctgggcaacacagtgagacactgtctctaaataataataataataatttttggtacttttataatatgtagccataactatttagtaaaaatatattaaagaaggttgctaaagatcaaatttagtgaaaggctttcgagcagctttagaataggtctactaactattaaataatttttaattattatttttccttaatctctttctgcttgaaacaggagatcagtgcggttaattcttcaactatccaagcctcatattttggaacagacaagatcacccgtatcaacatagctggatggaaaacagatggcaaatggcagagagacatgtgcaatgtatgacatgaataagctcctttttacactagcatgcgagctttatgtttaacatgaatgtactttgcaaggtattgatgtatattcatggaaatcttccattcagttatccacaattatccgtgttctggggcctcaaattagttatccatttcccatttatttttattataaattgcacagattacaagggaagcaaatttgtataatcactcttgaataaattcttctcttgacaggagattaaatggtatgatcaatttctcatttaatttaagaaaaacaatttccaagttaactccatgaaattaatctttctctcctatacttaagattaatagactgctaacatcataagcagttaaatatttataaggccatatagtgaagataacattagtacctatctcacggagtgagaattaaatttatatatatgtgttttatatatataacacatatatataacacatatgtgtttatatatataacacatatatataaacacatatatataaatttaattctcactccgtgagataggtactaatgcataggtgctaattactaatgtgtgtgtgtgtgtgtgtatgtgtgtgtgtgtgtgtgtgtatgtatgtgtgtgtgcatatatatatatatatatatatatatatatatatatatatatgggttaggacatacgtatatatatgggttaggacagagcttagcctgtggtaggttctctattaacacctaagtattactccattttcatactgctataaagaactgccctagactgggtaatttataaaggaaagaggtttaattgactcacagttcagcatagctggggaggcctcaggaaacttacaatcacggcggaaggcaccgcttcactaggcagcaggaaggagaagtgccaagtgaagggggaagaatcccttataaaaccatcagatctcataagaactcactatcacgaaaacggcacgggggaaaccacccccatgaatcaattacctcgacctggtctctcctttgagacgtgcagattatggggattatggggattacaaatcaagataagatttggtcggggacacaaagtctaaccatatcaacctactagtataatttcttattatggaatcaagtgttgagacacgtcggtttccttgaacacttatttatttaatatttatataaatctttgtgccaggtgttgctacagctggaagatataaattgcattaatttagattggatcaacggttcacgggaatacatccatgctgtaaacaatctccgtgttgttggtgctgaggtggcttattttattgatgttctcatggtaagaagagttgatttttttttaattatattgaattggttttggatattaacactcagaagttgggacaatttaatgtctttttttattagcttagacaggtactgaacatgtgaaataataagcatttgtatatggcagacaaaaaaggaaaagtttcttcgcagtaaagagtctgtggttatttgaagcaccactaggtggcagtgtgtctacacaggctcatcactaaaaactgcccccgcaaggtcactgccttggtcagcatgttagaccacctcaatcagtttcatcaattgtaaatctatccttagaattataaattgttaccatccttcaaatattatttgtttagaatatgacatgtattttcacacaaaaacagggttctgtgcctgtgaattagttaggtctgtaggccagtccagacacaactatttaacacacatattctctaaaggaattaaatagaccttgctatttattaggcctatactctgcgacattcacgaatctccaaatgctttctaaaaagtaatttcccaccctaaaatgcagtgtagtaaaatctaaagatgcataatcctttcagatttttaaggagggttcattcattcattcaacaaatatatatttcactctgcacttactgtgggctaggcatggaagatatgacttgtaagtaagacagtgtttctgctctgacaaaatgtacactctagtaggcaatggaggcacacacagaaacaaatgaacaagaaaatgtcagttggtgacaagtactgggtgaagaaaatgcaaggcagtagaatggagaatggcagaagcagaaacaaattgtatgaacaaccaggttaggtgatatttgaacattgaccactgtcagtaaacatcctgaagaaggaattagggatccaaagactcatttatgccccgacacttctctatcttctctttccactctatcagggaagactaaggtacaagatctttagagaaagtctttgaaaggatgaaatcagattcatcttcatcttctctttataaaaaaaaaaagccagctgtaagcttttgtgagtttctttattgaccttagggcctgagctgtgggctttcctatgtccaataaataaataatagtggttcataggaagctgacaggagatgtttgcagaactgaagggaaaaatgtttgttgaattaaaatgttcattgaattgaataggcagccttgaagtgggaaaagggtttagggtgagtgggctccagggcctctggggataattcaggattcaagcttaaagaaggagcagctaaaggaacagctgagtctcttctccacctctctttctgtcatctcatcacaagttactagcccaccacaattcaccacctggattggtactgaggcaagcaggtgcttgggaatggggtaggaagatggggaagaaggagaagaatgaaggggataagggctgagagtgatctcaaataccaacctatataaggagataggaaagaaaatagtcatttaaaatagcggcaacagtcggccgggagtggtggctaatgcctgtaatcccagcactttgggaggccaaggcgggtagatcacaaggtcaggagatcgagaccatcctggcgaacaaaatgaaaccccgtctttactaaaaatacaaaaaattagctgggtgtgttggcgggcacctgtagtcccagctactcgggaggctgaggcaggagaatggtgtgaacccgggaggcggagcttgcagtaagccgagatggcgccgctgcactccagcttgggccagagtgcgacgctgcgtctcaaaaaaaaaaaaaaaaaaaaaaaaaaatagtggcaacagtagaggaagggatgttctaatgaccatgtagcattcattggcagttattcacatatgtaaatgagagagaaaatattctttgttctgtgacttataaaactgtcataactggtggaaaaaaatggaatatttgatcaaatgaaaaatgtatgcaagtataaatcaattgcttgattttcatgataattatgagagcctgaaacttaggtgaaactaaaaatgcttgctcaggagtgacattattaagataataggaatagggagacctggatccttctttctctgacaagcacactgattcaacagtaacagacaaattttctttgtgagaaattaagaaactagttgagaggctcttacatcctgggtaaatataaaaccagctacaacgaaggccagaggaaaatttgagataccttcttgtcttaacttctacctctgacccagcaccatatgatctgaaggaaactcctagcttcccgcttcaccttgtggacagaaaaagtgggacgtcatatccaatgtttcagcttttctgggggctgcttagggtaatcacttcaatctcacatgtcttggagcactgatagaacccagaatattttagtatctaggggccaatgagaacaaagatgggaagaaagatgtcattcaagcagtcactatagccccttcccctagctcagtgcagacaaacaaagtgattgagtagaataccctagatcccatgttctccttgggaggaaaagagttaaactgcaaatcaaaagttccaacttttccaggggctgcctgagagactgatttctgtcttgactctcttggaagtgctgatggcactcagcttattctagatgcttgagggctgctaagaatgaagatagtagtttggaccagcacaaagttttgacaggtgcccagaactgttggctaggctgattggtgagagtcttctcccacaaagaacaatccatgaacaccctcgcagaggtggctattttttctaatgtgcaaataccaacataaagagtcaaggaaaatgaagaaacaatatataccaaagaaacagattcatctccagaaactaaccctaatgaaacagagatatatgatttaactgacagagaattccaactaaccatcataaaaatgttaaatgaggtcaggagaatgaatattgcatgaacaaagtgacaatttcaacaagaagattaaaaaaatataaaaagtaccaaacaaatcttggagcaaaagaatataataattgaaggctgagcgtggtggcccatgcctgcaatcacaacattttgggaggccaagacaggcagatcacttgatgtcaggaagtcgagaccaacctggtcagcatggtgaaaccccatctctactaaaaatacaaaaaagtagctggtcatggtggcgcgcacctgtaatcccagctacatgggaggctaaggcataagaatcacttgaacctgggaggcggaggttgcagtgagctgagatggtgccactgcactccagcctgggtaacagactgcactccagcctgggcagcagagtgagactccatcaaaaaaaaaaaaaaatgaaagaggaaggaaggaaggagagagagagagagaaaaggaaggaaggaaggaaagaaagaaagaaagagaaagaaagaaagaaaagaaacagaaagaaagagggaaagtatgtggaaatataaaactctctggtaaaggtaaacatatagacaaatacaaaatactgtaacatgtgtgtgtaaattacttttaattctagtataaaagttaaaagacaaaagtattaagaataactataactaaaaatatgttaatggatacacaataaaaaagacgtaattatgacatcaataacatgaagcatgtgatgtgaacaagtaaaagtgttgactttggcgtatatgattgaaattaagttgttatctccttaaaatacactattatactattataagatattttatgtaaaccctatggtagtcacaaagaaagtacctatagaaaatacacgaaagatttaaaaaagctatcaaagtatattaacacaaaaaatcaacaaaacacaaaggaagacaacaagagaggaaaagaggaccaaagaactataagacagaaaggtaggaaacaatttttttaaatggtaatagtggtccgatgtggtggctcatgcctgtaatcccagtactttgggaagctgacgtgggaggatcacttgagacctggagttcaacacaagcctgggcaacatagtgagaccctgtctctataaaaaggtgttttgttttgttttgttttgttttgttttgttttgttttagggctgggtgcggtggcccacacctgtaatcccagcactttgtgagaccgaggcaggcggatcacttgaggtcaagagttcaagaccagcctggccaacgtggtgaaatcccatatctactaaaaatacaaaaattagctggccatactggtgggtgcctgtaatcccacctactcaggaggctaaggcaggacaattgcttgaacctgggaggcagaggttgcagtgagccaagatagtgccattacactccagccttggcaatagagcaagactccatctcaaaaaaaaaaaaaaaaaaaaatttctaattagctgggcgtggtaacatgcacccgtagtcctagatactcaggaggctgaggcaggaggattctttgagtccaaaggtttgaaggtacactgagctgtgataatgatcttgccactgcactccagcctgactggcagagcaagaccctgtctcaaaacgagacaaaacaaacaaaaaacaataagtccttctccatcaataatactttaaatgtaaatgtattaaactctctaatcaaaagatatagagtgattgaatagatagttttgaaaagatttaactacatgctgtctacaagagattcattttatattttggagacacacataggtttaaagtgaagagatggaaaagaataatcaacacaaatggtaaccataagaaaacaaatgaatgtacttgtatctgacaaaatagactttacgtcagaaagtatcacaagtgacaaaggtcattatataatgataaaagaatcaattcaccaggaagatataataattataaatatatatacacccaacaccagagtacctaaatatataaagcaaacattgacagattggaagggagaaatacacagcagtgaaataatagtaggagccttcattatctgattttcaataatggatagatcacctagatggaaaacaaataagaagaaaacttatttgaacaacaacttcagcaacactatagaccaaatggacctaacacatgtgcatagaatatttcacccaacagcagaatacactttcgtctcaggtacacacagaaccttcgccaggatagatcacaagtgaggtcagaacaaaatcttagccaactcaagaagattgcaatcataccaagtatctttcttgaccacagtagaatgaaactagaaatcaatagcaaaaggaaaactggaaaatacacaaatatgtgcaaattaaacagaaaacttttaaacaaccaatgggtcaaagaataaatcaaaagagaaattataaaataccattagacaaatgaaaacaaaaacacaacataccaaaacctatgggattcagcaaaagcaaactaagaaggaagtttatagtgataaacacctaaatttaaaaagaaaaaagctctccattcaacaacctaactttatacctaaaagaactagatcaagcttgcccaacccacagcccagaacagctttgaatgtggccccacacaaatttgtaaactttcttaaaacattatgagatttatgcatggaccttatttttaagctcatcagatatcattagtgttaatttattttatgtgtggcccaagacaattcttcttccactgtggcatggggaaaccaaaaaattggatacccctgaactagataaaggagaataaacttattctaaagttagcagaagaagggaaataataaaaattacagtagaaatgaacaaaatagtgaatacaaaaacaatattaagaaatgaacaaaactacaagttggtttgttgaaaagatgaacaacatttacaaacctttagctagactaaaaaaaacttgagaagactaacatttaaaaaataagaaataaaaaggagacatgacaattgagaccacagaaataaaaggaacatgagactagtataaataattacacaacaaaatttaagataacctagaagaaatagataaattcctagaaacatacaacataccaaagctgaatcatgaagaaacagaaaatctgaacagacctgtattaaagaagacacaaataaatggaaaaacatcctgtgttcatgaatcaaaagagtcaatattatcaaaatgttcatactacccaaagctatctacagattcaacgtaatacctatcaaaattccagtggccttttttttaacagaaatagtaaaaacaattgtgaaatgtatatggaagcacaaaggaccctgaatagccaaaacaatctcgagaaagaagaactaagctggaatcatcacagttcctgatttcaaaatttattatgaaagtacagcaattaaagcagtgtggcactggcataaagacagaatagagatctcagaaggaaactcatgtatgtatggtcaactgatcttccacaagggtgccaagaatacacaatgaagaaaggataggctcttcctacaactggcattgggaaagctggatatccacataaaaatgaattaaatttgacccttgtcttacactatatacacacacacacaaatcaatttgaaatagattatagacaaacataacacctaaaactataaaactcctagaaaaaaacatagaagaaaagctttatgacattggacttgacaatgatttcctggatatttcaccaaaatcacaggcagcaaaagcaaaaatagacaaagaggaggatgtgctttggatgcgtgtcccctccaaatcttatgttgaaatgtggtcatcaatttggaggtgggaatagtgggaggtttggaatcatgggggtggatcccccatgaatggcttagtgccatcctcttgatgatgagtgagttcttgctcagttagttcacacaatatctgtttgtttaaaagagcatggtacctccccacttactctcttgctcctgctcttgccatgtgataccccagtcccacctttgccttccaccgtgattgtaagcttccggacataagcagatgctggcactatgctttatgtatagcctacagaaccatgagccaattaaacctcttttctttatgaattacccagccttagatatttcttcatagcaacacaagaatgaactaacacaaaaaaaattagtaaaaaggagcagggcattgctataaagatacttcaaaatgtggaagtgattttggagctgggaaatgagcaatgttgggagagttgtggggctcagaagaatacaggaagatgagggaaagtttgaaacttcttagagacttgttaaatggttgtgaccaaaatgatgatagagatatggacagtgaaatccaggctgatgaagtctcagatagaaatgacaaagttattgggaactggagtaagggtcacccatgttacaccctaccaaagtgcttagctgcattgtgtccacaccctggggatctgtggtatgttgaacttaagagtaatgacttcaggtatctagcagaagaagtttctaagcagcaaagcattcaagatatgacctggctgcttctaacaatctacaatcagatatgggagcaaataaatgacttaaagttggaacttatatttcaaagggaagcaaaacattgaagtttggaaaatttgcagcctagcctagccatgtggcagacaaaaaaagctttttcaagagcagaatgtaagtgggctgtggagcaaccatttgctagagagattagcatgactaaaagggagctgggtgctactatccaagacaatggggaaaaggcctgaaaggcatttcagagatctttgaggcagcccctcccatcacaagcccagatgtctaaaaggaaagaatggtttcagaacccaggcctagggtgccactgccctgctcagccttcaggacactgctccctgcatcccagctgctcaggctccaccctcagcaactagggccccagatacagcttagaacacagctctggagggtgcaagccatgagccttggcagttttcaagtggtgttaaatctgcagatgctcagagtgcaagtgtgaaggaagcttggcagcttccacctagatttcagaggatgtatagataagtctgtgtgcccaggcagaagtctgctgcaggggcagagcccccacagagaaactctactaaggcaatgccaagaagaaatgtggggttggaacccccacacagagtccccactggggaactgcctagtggatctgtgggaaggggctcctgccctccagatcccagaatgttagatccactggaagatccatgattataaaaactggcaggcactcaactccaaccccagagagcagcatgtgggttgcacccagagaagccacaggggcagggctgcccaaggccttgggatcccactcctcacaccagaatatggaacatggagtcaaggattatgttggatctttaagatttaatgcctgccctgctgggtttcagatttgcatggggcctattacctctttcttttggccaatttctcttttttggaattgaactgtttacccaattcctgtacctcccttatgtcttggaagtaaataacttgttttttattttacaggctcataggtaaaaggaacttggccttgagtctcagatgagaactttgactttgagctttgagttgatgctagaatgattaatatgttgggggaagagtaagaagggatgattgtattttgcaatgtgaaacggacatgaggtgtaggggggccaggagtggaatgatatggtttggatgtgtgtcccctccaaatctcatattgaaatgtcatccccaatttggaaatggggcttagtgggaggtattagatcatggggatgaatctctcatgaatggtttagtgccacccccttggtgatgagtgagtacttgctcggttagttcacacaagatctgattgtaaagagcacggcccctccccacttgccttttactcctgctctcactctgtgatacaccagctcctcctttgccttccccgatgattctaagctccctgaggcctcaccagaagcagatgccagcactatttaagttctgggatacatgtgcagaatgtgcaggttttttacataggtatagacgtgccgtgatggtttgctgcacctatcaacccatcatctaggttttaagccctgcattcattaggtatttgtcttaatgctctccctccccttgtcccccacccccaacaggccgcacgatgtgttgttccctccctgtgtccatgtgttctcattgttcaactcccacttacgagtgagaacattcagtgtttggttttctgttctggtgttagtttgctgagaatgatggcttccagcttcatctgtgtccctgcaaaggacatgatctcattcttttttttttgagatttgagacggagtttcgctctgttgcccaggctggagtgcagtggcctgatctcagctcactgcaacctctgccttctgggttcaagtgattctcctgcttcagcttactgagtagctgggattacaggcacacaccaccacgactggctaatttttctatttttttagtagagatgggtttcactatgttggtcaggctggtctcgaactcctgacctcgtgatctgcccgcctcagcctcccaaagtgctgggattacaggcgtgagcccccacgcctggcagatgtaccattttttaataatgagagtgttttaaacctactcttagcaattttgaaatatacaatgcattactattaatgctaagcaataaatctcagaaacttattcctcctgtgtaactgaagctttgtacccactaatcaatatctccctattcaccacaccccaatctcagtccctgataactactattatcctctacttacgtagtttgactttttaaaattccacatattaagtgaggtcatgcagtgtttgtctttctatgcctggcttctttcacttagcatgtcttccatgttgtcacaaatgacagaatttcctttttcattgtgcaggtataacacattttctttatccattaattcattgatggacacaggttgattccatatttcggctattgagaataatgctgcaatgaaatggaagtgcaaatatctcttcttcagcataatgattttgatacctttgcatatattcccagaagtgagattgatagatcatatagtaattctatttttagtttttcaaggcacctccatattattctccatagtggctatacctatttacgttccctccacagtgttcaagttttcccttttctccaaatctttgacagctcttgtttaatttataagagacattctaacagatgtgaggtgatatctcattgtgatgttgatttgcatttctctaatgattaaggatgttcaacattttttcataaatctgttggccatttgtatgtcttcttttgataactattcaaatcctttgcccattttcaattggatcatttgctttcttgatattgagttatttgagtttgtgaatattcttaaaagctcctgttttaaaaccaaagttatcccatacattttctagtgttgccttaacctgggatacagacacaggcaaggtggataactgtaggaatgagctgcctttgatgcatgttgtgagcatgctgaaaggatttgggcctcaggaaggatcagcatggagctagaagccacgaatatagttgttagggctgttctcctgtttccaaggaccacaggccagccccttagcacaaggaggagagctcctatagaaggcattcttccaagctcatctgttctccttcagttggataaggatgtaggcagaggtgtcactttgtgactttaccagtccctgtcttatgtgcaaaagggagaaccatgttgatccttttttttttctatttttaaagcatatttaagctattccaccgctgtttttaaaatacttattctgttaaacaattctttcagaaaaaatttgaatattccccttctaaagtgcacttgattggccacagcttgggagcacacctggctggggaagctgggtcaaggataccaggccttggaagaataactggtaagcatgccctgcagttgggccttgagtgtgtttaaatattgtttacacacactaccaagtatctgaacaccaagtaatactgcagaagaaaatataagatactacaaaatgtgattccaatgaaataaaacgtgaacgtgttttcagagcagaaatgtgcagattcgcttcaagggggttcattgcagcgttgtctgtggtgacaaagtaagagaaactatgtgttccctcacccgcaattgaatggttgaagcaattataacacattccatcctttgggatttcataccagtaatgcaaagagtgaggtttacctagacgtaggagtagaatggtggttatgagaggctgggaagggaagaagagaggggaggctaaagagaagttggttaacaggtacaaaaatccatagctagaaggagtacattctagtacatgatacagaaattacagttaacaataatttattacatgtttcaaaatagctagaagagaaggactgtaatgttcccaacacgaagaaaagatgaatgattatggcgatggatgtcccaattaccctgatttgatcattacacattgtatacatgtctcaaaataccacatgtgcccccaaaatatggacaactattatatatcaatttttaaaagttatttttaaaaagaatgagtttgaatcccactgattgtcctggacgttcctgacacacttggactgcagcttactcagttgttaccatttttaatattatccctggatataccgttaagtctaaaaataagttgcggagcaaagtatatagcatgaattgggtttgggggtataataattaatcatgtctcctccccacattctgttttccaaaccaattgtgtgagatggatgaaggtcaaagcaacagctcctttaccaacaggcggggctggcctctccctctgcatccccccaccaacagccagtaagcaagccccacgtctccttcatctgccttttccctgtccatcctctggtcattgtcctggctcagtccctcatctcttgcctgcattttggccttggtccccgctggtgccccagcctagtcttctacaaatactgccaggcttatctttccaggtgcaggccatgccactccactgctccaaatctctcagggtgtctccttgtgtgaagcctcttagcttgtcacgtaaacttgtcatgtttcatcacagtttttcatgctctgtgcctttgcacgtgctgttgtccctcttgctgagcattcactgtccatttgtcaagattcatctcaaatgtttcctcctcaggcaggaattaattctctgtgcttctcataccctttgacatgtgcctcttttgtgtttgaaaacacaaatattatatcacatggtcttataattatggatgagcctgttatttttaacagaaagcctccttactgcattgactccaggcttggccacagaagcgtattttctctttgttaaactgctgtgctctgtgtgcatgtgtgtgtacgtgctcgctctctctctcacacacacacacatacatgcacactttaaattcaaatctcaatttagaacacagtttttaaaaaaatacctagaagtccaaattgggattattttgtctctgcaatctgttgatataacaggcttattcctgctataagtcatctctcttctcctaactctctgctcctaaatcctcctcactcacctccaccaccaccaccaccattcttatttagaataataaaaactgaactttttcactgaagtcattatgtgaccctttgtggtcaattttcaagcccagaaaaaagaaggaatgagttcctcttttgaagatggaacctcatggggcctcacagcctcaggcaggctgagtgaagcagaacacataactgcatttacaattcatactgggttatgatcaattcaaagagattttgtttttattaagttttttcaaaaatcagatactatttaactctagtttttcccatcaggtgaattatcctgctgggtaaatagaaaacagatttttaaaggttttctgaatgtccaaagaattaatattatgtggatgttttaatctatattcctctgagaaattagtttttgggcaatcatgttccttgagtaatagaagaactgagacctcacaaacagattttagctgtataattaaccacttaaaaacaaaattaatatgataaacatattaaggacatacataagtttttatgtctttggtatttatgtataagtggtaagtagttgtcataataaatatagttagggggttactcagctgattctgcttttatttatttttatttataaacagtatcaacgcttttcttatttgaggaaaaattactctcattttgctgacacacacgtaccaaaatacacatacatactacacactcagatcctaaacgattagttctcactcatgtagtaagaggtcatgtctgtctccctaaggttaattaataggttgaacctaataattctcttcccttctgtagacttttctcctgagatatcctagaacaacaaattcaatgttccctcttccttacgtcttggaaagactgtcttttttttttttttttaatctgattgccttgtcctccaatcaataagatctgaggtatacctatcttgggatgtttctctccaggaatcctgactttattagaaagttgtgtgtaatcacactagtaaaataaaaattcttccaagagttgaagattaattgtgagataaatactttttcctctttgttaagcgcgaatggttcattcatatgcatgttgcattacttcattgatctctttgtctaagtgtctttccatctgtgctctgagttcccccgctttgtggacttaagtcatttgttcactttttttcaggtcttgtcaatagaagcgctgtgctgaaacgaaccccttccctcctggcctctcatttccttctaaatgatgccctagcctattgcattcctctagatccaagctccacaaagttgaaagtggagtgattgcatttccttagggttcattctctccttgacccactgctacctagcttctttccccaaaaccactattgccagatcactagtggctttttgtggaactctatcagacattttgactctgtgttttacttgacccctctgcagaatttgtcccagtggacccctcccgccttgctgaagtgctcccttctcttagcttctatgattccgcatcttcttggttgtctttgtttttttgactccctctctccaggctacttcatgaatttcttttcttttgcctttgcctatctgttcatattcttcaagtttccattctaggcccactcttctctcctgttgcttttctataatcactcttttagtgattatattagtcagaaaaataaaaaaaaaaaaaaacacatcctatgacaagctaagtgtgctgagcacacaccccagactgtgacacagacattccttccttgctgatgccacattcccagaggtgtcaacggcaatgctactctgcatccttcccactccgggatccagcctctatatcacagcaaagggattttgctaaaatataaatctgatcataaatctcccctgcttgcaagcttacaacagcttcccattgatgaccacatcatgtccaaactccttgacatggctcagctgacatctggctcctgctagcaatactaccttcatcttccaccgaatcctagaactctacacaccagccttagcaaactagttacagtttcccaaacacgatgctttcatctggaggccgtgtacttctctgtcctcccctgggttgctggccaccttacctttgccctggccaattcttctggcccttcagatctctactagtgtttcttttctttttctttttttgagatggagtcttgctctgtcacccaggctagagtgcagtcgcacaatcttggctcactgcaacctccacctccttgattcaagtgattctcctgcctcagcctcccaagtagctggcgttacacgtgcccactaccatgcctggctaaattttgtacttttagtagagacggggtttcaccatcttggcctggctggtgtcgaactcctgacctcgtgatccacccgcctcggcctccgagggtgctgggattacaggtgtgagccaccgcgcccagccatgtttcttatctcttgcagaagcatgtcctagttccgcaagactgggttatatgtggcttctctgtgcttggataacacttatgatcaccactgcctctgcacggaggacactgactggggtgcctttcccatcaaatggaaaatcccttgaagacaaagcaaggtcttattcctcatatctgaatgctaaacctagttcctggcacatactaggtgcttgacaaataattgtcaaatacagaaatgattgaatatgtgaaagatcataacattttaaagaattccagctatcttgcccttattttacgaaacatttgaacatgacgcaatgggatgagagtctggacacctggcctcttagtccagtttgcctctaacacatgataaccttgtccagtcacttcacttccctgggcttcgggcttttcatttgtattactattaatgaaagtagaactaagtgagccatagctcaggacaaggattctgttattttaattgtgttgctttgtagattcatctttacacatcaaagagtggttgtgtttttaatttaatttaattttttgcctacaaatgttgcttttcaagaacctttgtaattcataaccttattgtatatatggtattccatatacagaccctagaatagccactgtgatttttttaatttgttagctgttttggcattgtctcaacatagcattacttatctgtagatacttgacattgcaatatatagagaccctacatttatagatttaggttatgtatctgtactttttcctgagtgatctttgattgatagaaataatgtaggaaaggacacatgcttccaaagtaacaacaatattaatgtgcacttccatagaacatgtcttggttgtgctttctctagggttggacccagctgggccatttttccacaacactccaaaggaagtcaggctagacccctcggatgccaactttgttgacgttattcatacaaatgcagctcgcatcctctttgagcttggtaagttttaacagaatcagaaacttcattgaagcatagaggagatttttagaggcatttaccctgtttttatttatttcaggtgttggaaccattgatgcttgtggtcatcttgacttttacccaaatggagggaagcacatgccaggatgtgaagacttaattacacctttactgaaatttaacttcaatgcttacaaaaaaggtaaatactttctaaactatgaatgctactgatgcatattcacttagctctctccttagatgggatccacctacttttgtgtataatatacatataaaatgtattttctctcaaaacacagttgcatataagaagctctcccacctgttctcagatccacaagatcgggtaccgtgtcttcattaactttgtatccctggtgccttatcaatctctagcatattgcagtcactcaatataaacaaggaaggtgtgttattcactcagcaaatatgtattgagtgtttactatgtgctaggcattattctaggaacagcaaatatggaaatgaatacaaaagacaaaggtgcctccctgatggagttcattttctaacttgttaggaaaccaataaatagtgtaagagctaaggggacaaaataaagcattgaaggggaatatgatgtgttggtgacagtgaaggtaaagtagaagaagaaaattgttgacaggatggtaagggagtccttactgaaaagatgacctaaaggagttagccttatagacaccaaggggagaggcattccaggccaacagggggaagcaagtgtaagggctgaaaacaggagtcagcctggcaggttcacgacagtgaggagcctgttgtggctgaaactaggtaaaaggaaagaagtagggcataaggttggagagggaaccaggcagagggcaataacacaggactttgtggatggtagaaaagacttaagctttcactcaaatgagataggagccatgagtggattttgagcagagaagagacgtggtttgagttacttgtaacaagaatcactctggatgctgtaattacaaattaaacaagtagtatttaactttttatagtagtttccaataataatagttacaatatctatatggcatcaagttaaaaggcaccgaaaggttattatttgggaaatttgttcttccctatctctacatttcatcatataattaatgaaatacattacccataatatataataataataatatatatatatatgatgatatgataatggatacctggatgattctgaatatctcatagcccaatcccctgtagtcaagatatcaaggagttgaaattacttgctctttcatttggctgttgtagaggaaagatacagagatcatagtattgagtgtaactcaggtatctacttcactagaaataaattacaaaggtttaatatttgctctgaaagagaaaatgtgatcagaagtatatatttgtaatgactatattttaaaaacccacacaactgtctaatctacaggtgcaacaaataagaattaaggccaatttcacctagttcagataagcaaaattcatacaaaagaggcatattataaaattgattttccccattattttctatattacgactatgaatcctttctattaggacaaaatatagctcagaagacttcattacataattaattgttatacacagatcatatgaaattttatgaaagattaattcaactaaaatatacatttatcataagctatcattttgagacattttaagatttcctataactttattggattaaaagaacatttatcattcatgttaaacctttggatgagttttaagacttcaagatgttctattttacttaaatttattactaacaaaccattacttttaaaattaatagtttgctatattctaatgaaccgtcttgtctaaatcacaattaattgtgaatataaatctatagatatacagagacctaatgtaagagaagtctttgtttaataaaaatggatgatgccaattattaatctgtgctgacgatattacattatttctgaaactattctgtctcagttctctattgtgtaacaaaccacagtgaacaattacaagaaaaattgttattgcccagcgttctgagggtcagaattcaggcagagttctcctgagattctgcttcgtgtggtgttggctggagcaactcaggtgactgcatccagttgggggctgagctgggctaagctggatgaggaggtctgagatgaccctccgtgtcaggaaccctgggacttgttctcctctgtcaggtggtctgtcatccttcaggacctctctccccagacaggtagcctggatttcataatattgcaactgggtttcaggacagtaagagtggatgctggaaggtcttttaaggccttagaacttaaccaatgtcagtttctccacagaactgatcttggttctttgctactgggcaaagcaagttacaagatcagcctgtaatggggcaggggtatttttaacatggcctccatgttgagagaaggaatggttacataatactgcaaatgggtgaggacccaggaaggagtcatttgttggaagcaattattacataataattatactgcatatgctaaaaccaaaatctagtttctcaaagattggctaagctgtgtaggtcattcaaagaatagtccacgccattcagtaaaaatattgttatgtaaaataaaagaaagcataaatggctgggcacagtggctcacacctgtaatcccagcactttgagaggctgaggcaggaggatcacttgagacttgaggccaggagttcaagaccagcctgggcacaacaagatagtgaggcctcatctctaaaataaaaaaagaagaagaagaagaagaaagaaaagaaagaataaatgactagaatgttatgaaaattttggaatgtgcagatgtatttagatcttattattattccaataatcctaactattgatggcaataatgtcatgcttgataatgacaaaactaattcatctttagcattctttataaaaccccccacttgttacacctttaacccagcactggttcacaatgctgactgttttgtgattgaataggagggagttcagttattcttgcagaaacagagaggcagagtcttaactggtctacaatggagatactatatgcacagggatattgtgtcagaggtcctagtgatacaggatttttttccatgctgcttcaccagccagagacctccacagcctgcagtgcctctgcttgagtttcacttgcacctgctgggctcaccactggacttatctcacccacttggcctggcagcctgtgctcagctcactctgctgacctggatctcacacctgccaagggtgagccaggcatgcccactgctgtggtagggcaggtggcttcaggccagtacaggcactggttccacacgaggctgtggctggaccaggcatactgcaagcagcttccaccttgggcaccagcttctgaacgagggaaatgtggtggtgccaaaaaaacttggagatggcaggaaccacgcagccccaaagggggtgttacatacagcatgttacagctgtggcttagggagccttgaggtctaagcccccaggaaacattacggcttgtttgtgttacagctcatttgttcccaccctctgcacagttcagcgaataggggtgtgtctcacattgtttgatcccattgctgtactccagaccacagctcttgggctgtcccagccccactgcagcttcctgatgcgtggggtgggatggctacagtgtttcagcagctcctttggcacctgctgtttggtgggtctcaggttcttgtcccacgtccaggaagaaagaggttacacagacaactgaagagtgagcatggtggagaagagttttatcgagtgaccaaacagctcttggatgagaggggaacccaaagtgggtagcccctatctgaaggcaggtagttcccacccaaaggcaggtagtccccagagtgtggcttagtctgggctttttataggctcagaatgagggaggtgttggctgtaggtagccttggaaaaagcaacattagattggttaaaaaaccttgttcaggctgggtgcggtggctcacacctgcaatcccagcactttgggaggcctaggtgggtggatcacgaggtcagatcaagaccatcctggctaacatggtgaaaccccgtctctactaaaaacacaaaaaattagccggcgtggtggtgggcgcctgtagtcccagctactcgggaggctgaggcaggagaatggcgtgaaccccggaggtggagcttgcagtgagccgagattgcaccactgcactccagcctgggtgacagagccagactccatctaaaaaaaaaacaaaacaaacaaacaaacaaacaaaaaaccttgttcagaaagaaccaaaaacgttgttcaggaaagaccaggcaaacaggaatcgaagttctcactctggtcagggactttacctggaactggcagcttcgttttcaggcttcacactgtttttggcttaaaggttgggtttcactgaggacacacccctatctgcctaggaaattgtctgcctcctgccactgtcactaggaagtgactcagtatatttgtgtcaaagcacaaagtcattcacatttgcttttgcttatttccacttcttgaatgtcccttttgagtcacataattctttggtacaaataaaattatatgtaactttgataaatgtacaatatccaagcctagacaaaaggtctggccctcccaactcaagaagactgccacttacagttactgtttctaagatatggtttatgctaccagttatcagttaattgctatcagttaattgggaattgttttcacagaaatggcttccttctttgactgtaaccatgcccgaagttatcaattttatgctgaaagcattcttaatcctgatgcatttattgcttatccttgtagatcctacacatcttttaaagcagtaagtaaatcatcttacttggaatttaattataaagtaattttttgaaacacaatcatccagctaaacattagggctttgtgtaggtagcaaaaaaaatgcacctgccattttgggaaataatggattgtttctgtgctgagtactgaacagtagctgggattgctggagggttgaaataactcaaccaactatttgtattctggttgtttcagctcctttgaaaattatatacaattttgcttttttggccatttgttatgcagtaattagatgttactgtgtaacaggcataagtctagggcaaaaatatttctgcatatatattttaaatgtcatcttcaaagatgccctaagaaggctgaaccaatcaatagctacaaccaaacatattactatttacttggaacatgaaaattattttattaaaatttaattatttatacagagcagaactaaagcatagatagctcacaggagctctacacagatcaatatgtgacaaactaccaaatctgattttacttgagtaaaagaaagaaaatctattttgtagtgggaagtggaaaagatcttcattcttgtgctttagagacctaatcccctgttttatcacggtagaaaatgtgggctgttcagctgaagtttatggtaagtaatagtacttcgtgaataagtgctgtgttgtgacatgaagaagcatgtcccttttgctacagagcttggcagatggacgggtttaggccatcctgtcagtttcctgccattcttggaaagcttgacagccaaacagtagcattttccacatatcctccttgtccccgacctctctcttcttcctgcctcggctgctactctgagcacccacgggatcctggcatttacttctaggagaagcaggcccttggagtctttgtatatttggagataagagttaatctgccaaattggagtacccttagaagctagctcatgccacatggatgctacttgtggttacaaactattagaatgaatcaatttccttgacgtactttattgtactgtaccctaatagtcatacaatcaaagtgtgtcagagccagctgtggcatgcacctgtagtcccagctacttgggaggttgatgcaggagatctcttaagcccagaaatttgaggctacagtgtgctatgatcatgcctctgaataacaactgcattccagactgggtgacaaattgagactccatctcaaaaaataaataaataaataaataggatgttacagtagccctagcctaaatgtctatggtttattaaattaaaagttcaaagcctaaaatagcaaatactcaagcactgctacccatgtttttaaaatgttcacatttcattccttttcctttagatttttaaaacatacaaataaaattaaagaagcaaacgaccttatattcccttcaatccttcccctaaggcagagttgaatttgatatgtatcaaataaatgctttcatattatgtttctggatttgctgttttcattaaatattataaatataaaatttgaaatttacattgatgtagatagatctaatgtatttattttataggaatcaggcataatttattgattagttctcctactaatgtgagtttttattgtttccagtttttgttattaaaagtaatgtcggccgggcgcggtggctcacgcttgtaatcccagcactttgggaggccgaggaaggcggatcactaggtcaggagatcgagaccatcctggttaacatggtgaaaccctgtctctactaaaaatacaaaaaattagccgggcgtggtggcgggtgcctgtagtcctagctactcgggaggctgaggcaggagaatggcatcaacccgggaggcggagcttgcagtgagccaagatcgggccactgcactccagcctgggcaacagagccagactctgtctcgcaaaaaaaaaaaaaaaaaaaaaaaaaagcaacgtctaccaactctgccatctttgtatgtctctttatgtacttgagtggaattccttcatggcatacaacagaagtgaaattatcaaagcatacatgcatttccttctttattagacattaccaaatcactgtttaaaatgtctatcgattgctaaagaaaaataaaaatgaaggccacaatttagatataacccaaggccacccatgaccacatagccaaaaccaagtcatcctgattttccagaaacactagctctaatcataaatgaaacacaaaaacataagctttacctccttgtccgcgtgattcagggaaatgaaaccaatcagctgtagacaaatcaacataaatatctctacttgccctagagaagaatgttaatgcataatagccaatcaccaaaaaaggtcaaaatacttccgcctttataaactgtcttgtgactgctgtaagcgggggcttcttaccattttcagtttgaagtctcccagctcaaggactgttcttttgtgtgcagagcaaatttttaaaaattaaaaaatttgatctgattatatttttgacattttaaaaattatattccaggctgggaatgcagtgaagaacaatacaactttccatcagaagcaaatgagaattcccctattacacgtattcagtgttgccaattgctttaatgtttgcaaatctgctgaatatgaaattttaccttgttttaattaacatatgcttgacaactagtaagactgaacatcttgcatagttattgactatttgagtttcctcttccgtggattgtctattcatatcatctacccatttttctaatagggagtttctctttttccctcagttggttttgttttatttttgaaaacagacatggtggcctgttaggcacttttaaaatgcatatcctttatttagatcctggagatttattattatttaataatatatagcgagtttattgaaggacaacatttctaattacataagtaatcacctttcattttctgtcatcagggaaattgcttcttttgttccaaagaaggttgcccaacaatgggtcattttgctgatagatttcacttcaaaaatatgaagactaatggatcacattattttttaaacacagggtccctttccccatttgcccgtaagtatcatagctaagtttaattgtaatgctttaaggtacttatctttaaaaattcaacagtttttattgagtgtctactaaataactgggcattaggccagactgggatttcagtgaagaacaacacagtgaggtctttaattgagtttaggctagtgggaaagacagcaagtaaaatctcagttccaatcctgcgtaataaactttctcttaggaaacattcaagatatgtgcagagcataaaggtcagagagcctttcgaggaaaagagatttctaagctgactcctgaaggatgagtaagagggagaagggaagtattccaggcagaagtgaccacgtctgtaaatgcctggaagtaagagagagcagaaactgaaagaaggccctgccaggattgtagagactgggaggacagtgatagcagatgaagtgggagagacaaatcaggtcagatcatgaggcaagggccttgtgtcccaagtggagaggttgggctttgtctgtgggtgaatggaaagccattgaagggtattaagaattaccagattatttttatttttagaaaaatcactttagtttctgcatggattagaaggccacaagatggaagcagggtgcctgttacacaattattgccacaattcaggcaaaaaaaaaaaaaaaatagaagtagagaggttgcaaagatagttagaaggtggaagcaaaatggacctaggtgaatggatttaaaaatgcagaaaagcaaggagtcaaggacaattctggctgtggatgagctgtcattctctgagcttgacgacacaggaagaaaggctagtttggagcaagatgataggctagtttctccatgttacgttggagctgcctttagggtttgagagtgtgtgtgcaccatgaggcaggtagagatacggatctcagcctctggaaatggatgtgttctacagatagagagttgggagtcactcagactgtagtcagtgtggtgaaagtggatgacatcactacccaagaagaatgtgccagataagaagtaaagatagcagagaaagaggcccctgcaaaggagactgaagaatgggcagagagaaggaagaccagcaaagcttatcgttaaaagagccaaggaaagaaagttgagcaggaagagaggagacatacaccacagcaaatatatatatatatataatttttttttttttgagatggagtcttgctctgtcgcccaggctggagtgcagtggtgcgatctcggctcactgcaagctccacctcccaggttcatgccattctcctgcctcagcctcccaagtagctgggattacaggcgccgccaccacgctaggctagttttttgtatttttagtagagacggggtttcaccgtgttagccaggatggtctccatctcctgacctcgtgatctgaccgcctcggactcccaaagtgctgggattacaggcgtgaggccccgagcccggcccacaccaaatatttttatgacttctaaaaatggaagtcctgtgtcttcttttgtctatttcctttgtattgtggtcaaatgagacagggccccatagaggctcattggatgaagaaacagttcaacccttagtgagcttggctggggtggtttcagtggagagacagcagggggagccaggttccagtagaatgggcggagaagagaaagaaaattctttggcaatgattaactcatgaattaaaattcctctctggtaggtttctttcccctttcaattattttcaaataatcatatgaagaattgcattttttcagtttgttattaagcgtacagtaatttcagaattcagaataaaagatctgtttagctctagatgtaaaaagtcacatttggccatttgcaagggaatgatctactgacagatactatattgatctgtatctacgtgtactgggcattcttagcacatatccctgcaggagaagaagaatgactcactttgcctctaaatgattataaaagcatacatcttcttgcccaattggtttcctagatttttctggattaattgtcacattatggcaaataaaaacttggctatagaaagtatacatactatatatatgccacacaatacaaaggaaataggcaaaagaagacacaggacttccatttttaaaagtcataaaaatgcctggaaaaataaataattttcttttaaaatattattaaactatttattctggaaaattaaaatgtgacccataatgtgtatttttaaacgtagtttttcaccaaattcactgaaactaaagttgtatttttgcatgaatatgtgcagcactgttcaaatacaaccctgaaaattttatttccattaaaggatccaggaagtcatacttcccatgtgtttttaaccctttctctccctttccttcttgtttccttatatctaggttggaggcacaaattgtctgttaaactcagtggaagcgaagtcactcaaggaactgtctttcttcgtgtaggcggggcagttaggaaaactggggagtttgccattgtcaggtaggcagagtgagaaactgacgctttgcacagtgctgggggctcagtaacactaagtgagactggctcagtaagctgtttagtcttctcttttcctacaattccacaggctaccatggtatctttgatttttctttttacttcatgttttccaaatataaagtagaaatcataatatgtattttctctacagttccaactagaaacagaaaatgttaggaagtgataacatgaaaatacagatctagataatagagcaagtggaaaaaactgacggtattcaagatatatttttaatcccattcacttaatattatacaaatataagcatatatttttatttgtgtcagtaacaaataagacatttatataaattgctaaatttctaataagctgtctaagcattacccacagatacaggacatgtgttagaatagtcagaggttaaaaataatccagttcagatgttcattttgtatcttttgctaaaccctccttttatcttgaaattttcttaatcttttatttgttcagccttagcatttttgtattatgttcatgtccattattttattctgtaatttatgtcagaattaacattatacctactaattagatgcaaccttttctgcaaacagatgaatgtattaggtgttttatctctgtgatttccatcatcctcaaacactgggcacaggcacgaaaagcagagattttgtggttattttgtcagttgagagatgcatccgttttatcactggcagagtttctgcaggtcatcttgccttggtccaactgcctgtaaatataagctcagtgaatgatgatctggatcctgattggtgcacaggctccagcccacccttctcctaaccatgtctcccaccatttgactttattccaccttcagttcagcgaggctacactgtttgcactacccagtactgaatagatcctacccttacctttctgcaggacttcacccatgctgtttctttgctgcagatactttttcctgtctgctattttgtttctacctcttcttcatggctccatcaagcctccctctgagagcagttcagcataatcatgtgcctgtggttttgaggctcacaggacgctgggtaaagctgtgtgatttgtgccctgcacagaggcatctaacctggggcagctggtgatgaatatgcagtttctgcctcttttaagatttgtgagagcgtttccacatctctgttcttttgataacggccgaagaagctgtttgtaatgctgttgcatagttacccaatcctcttttaagaataagtaagcattgaaggttcacagcagatgtgtcatcttgaaatgaagtcagctagctaaatttgtatgctggtttagttctattcttcaaacaagttttataagtccagcttctccatgctcatggataggcagaatcaatatcattaaaatggcaatatcaataacatgaaaagacagatctagataattgagcaagtggaaacaaaatgatggtatataaggtatatttttaatcccatccatttaatactatacaaatgtaagcatatatttttacttgtgcaactcacaaataaataagaccattatataagttgctaaatttctttttctttctttctttcttttttttgagttggagtctcactctgtcacccaggctggagtgtagtggcatgatctcacctcactgcaacttccccttcccgggttcaagtgattatcctgcctcagcctcctgggtaactgagattacaggtgcccaccaccatgcctggctaatttttgtatttttagtagagacggggttcaccatgtttgccaggctgatctcgaactcctagcctcaagtgatccacccacttcggcctcccaaaatactggtattataggcctgagccaccgcacctggccaaactgctaaatttctaataggctatctacgcccaaagcaatttatagattcaatgctatctatattaaactaccattgagtttcttcacagaaatagatgaaactattttaaaattcatatggaaccaaaaaaaaaaaaaaaaaaaagatcccaaatagccaaggcaatcctaaacaaaaagaacaaagctggaggcatcatgctacccaacttcaaactacactacagggctacagtaaccaaaacagcatggtactgctacaaaaacagacacatagacccaacggaatagagaatagagaatccagaaataaggccgcatacctatagctatctgatctctgacaaacctgtcaaaaacaagcaatggggaaagaatcccctactcaataaatggtgctgggatacctggctagccatatgccaaagactgaaactggacctcttgcttacaccatatattacaagaattaactcaagatagattaaagacttaaatgtaaaacccagaactataaaaaccctggaaaacaacttaggtaataccactcaggacacaggcacaggcaaagatttcatgatgaagatgccaaaagcaattgcaacgaaagcaaaaattaacaaatgggatctaattaaactaaagagcttcgacacagcaaaacaaactatcaacagagtgaacagacaacctacagaatgggagaaaactttggcaacctatccatctgataaacgtctaatatcccacatctgtaaggaacttaaacaaatttacaaggcaaaaacaaacaactacattaccaagcgggcaaaggacatcaacagacacttttcaaaagaagacatatgcatggccatcaagcatatgaaaaaaagctcaacatcactgatcattagagaaatgcaaatcaaaactacaataagataccatctcacaccagtcagaatggctattattaaaagtcaaaaaataacatgctggtgaggttttggagaaaaaggaacacctatacactgctggttggaatgtaaatttgttcaaccattgtggaaggcctcaaagacctaaagacagaaatatcatttgacccagcaatcgcattactgattatatacccaaaggaatagaaattgttctattgtaaagacacatgcatgcatatgttcatgcagcactattcacaacagcaaagacatggaatcaacccatgtgcccatcaatgacagactggataaagaaaatgtggtacttatataccatggaatactatgcagccataaaaaagaatgagatcatgtcctttgcaggaacatggatggagctggaggccattatccttagcaaactaatgcaggaacaggaaaccaaatactgaatgttctcacttataagtgggagctaaatgatgagaacacatggacacacagaaggaaacaacacacaccaggacctatcagagggtgaagggtgggaggagggagaggatcaggaaaaataactaatgggtactaggcttaatgtctgggtgatgaagtaatctgtacaacagacacatgtttacctatgtacctgcacatgtacccctgaccttgtttaaaaaaaatgtccagcttcaccataggttatatcttagctaattgggcttctagtgacataaagggctgcaatgtatgggcaatgagtgaagatagttcttggaataacagaaagattacccttaagaacttggaagaacagtttcctctggtaattaaatcaattaattctactagtaatataataagacagaccctaggaatagcaatattcattcgttaattcattcagcaaatatgtaggtgcctacgctgtaccaggaactgttctaattgctggggatgcagacacaggtccgtctttcacagagcttatatttgcagtttgagtagacaaatgatacattaacagaagaatagttataagttatgaagaaataaggaaaggtgatacagtatggagcaacatggggacaaatttagattggattgtagcttaatcatttactaactatagtttaatttattttaccaacacaacaaaaaaagggactgtttcatcagaaggagaatattagcaatagccataggaaatgggagtcaggaagctcttatgggtaagagatgttggtttgggtgccacgaccaatctgggtcacagtggagaatttttgcatgatggggaaaaaacaagtcattggtttcactttgccttggatggaacataccttatgccttgagatatggcacctctctctgctctattgccgtgatcaacaaaatgtcttttgatcactagtttagttacccaattccttttatgtggttaaagaaggtaccagaaaaagggcacgggagcactctggttaatcgaagggaggtatttccacactgtgaattggtgaacaggctcctggtttgtagataagtcttgtgtacatttagtccactattgagagtttcttgatttcctggtgtcagtataatctggtttctgatactacaaagccaagaccagatctttcactatggagaaatcacaataatgcctctctaggtattctctaaaaatcacctagccaagctttccatttacttcacccttctttcaaacttcagaaccatgctattctgagatgctgatcaatacacatggaaagaataaatctcctacaagcaaatgctagcaaatacaagtttctcttccatagtgcatacacagatgtgttttctttcattcagtgctgtgaatacccagtgcaaacttacgagtcttatttttgtttacagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataagtaagtattgctttttccttttcattttcgtagtttacattttataaatggtgtttaaacccacagataatttgaaatgtgcaagtagcataaaaatttatagactttgaaattttgcaattaaagaaagggaaaagttaagaaaccaatgctatatgtgcagaagtgttagaaaataagaattactcattaaatcgggggatctaccgtgtctttttcttccctggcatcaggttaaaattccttttttttttccttaaaaactttcagatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtatagcccccttcctccaaagtccctgccacaggagaattactcctctccctgggtcttgaatgctctatggtgaatttgtatttagcctcaaggcagcatttcatttgtaaagcacttgggtaaccctttgttcttgcaataacaatattataatatttaaatgtgtccattgtgtttcttttttctttatgttgcttcaatttcttccaagtcggttgtccttagccagcgaaagggagaaatttcatactttcatttgctctgttttctatcactaggctcagtgtttagcctataggtctgcgctataaatattgttggaaggaaatgatgacagatactctgcagagggtttctcgattctccttggtgcctcgctgccagctgaaccttcagaaagacccgtgggtgtacataaataaatctgtgctgtggtggaaagcagagaagcatgtgggatgactctcccattttgcaaggaagggatggaagattgctggggagaaggaggaaagcaggttcagggacattggcatgatgtagcggtgtgtactgctctcactggtgggctgcacatattcacacctaggccaacctaggagcacagtggctatgagtaagctcagtagaagggactgagccatactgagtaattgtgtcgcagtccagcattcattagcaagctggtggtggagtcagcacagaccctggggagagaagtcttcctgagagcagctgtcccgagcctgcacaggtcccaaggtagaggaagagttatgcatccggccgtggccttaggcaacgtgagtactagctgcctcctcacccaggagatctctaggctggctccttcaaggtttgaaaagactaatgggagtcaattaacttctgagaaccctattttaataaagtatagacttactgtcctatagttcttaatatctgtccccttttttgcattataagaatgtatgaggatgaataatagtgcatgaactatctaggcaaaggaattccaaaagttcaaggtgacgccattattttctgtgtgtgcttttccctaaggaagcaccaaaaaaaatgattccctttccctctgagtgccctgcattattgtagcaagcaattgtggcctactactgtttgggcaaggactgttagggaattgttctgcttcctagatgaatgctgaaaatgcagtccaattacccattactccctccactctctgtgactattgacccacactcatgccttgtcatcatatcactcaaaaatgcgcacctccaaactcgccacgcggaatgtcctctttgaccacagttgcctccccttccggcttgctgacttttttttttttttaactgttaggcaaaatcttaaccttgaatactttcagatttcttttctctgggccagcacctgaagtgctgttgggacagtggtaccacagagaagacggatgtaattagaatgtatatgatatgatgtatattgtgatcagcactgtcctgaaatgcgtttcttttgacacctcctgccccaaactcttctgctactcctactttatatagaaaacagatgccatgatccgatagcaatctctactcttttttttttttctctgtcgcccaggctggagtgcagtggcgcgatctctgctcactgcaagctccacctcccgggttcacgccattctcctgcctcagcctccccaggtgcccgccaccaagcccagctaatttttttgtatttttagtagagacagggtttcaccatgttagccaggatggtcttgatctccggacctcgtgatctgcccgccttggcctcccaaagtgctgggattacaggcgtgaaccaccgctcccagccagcaatctctactctttttgatccaaacacatcaactacctacatctgcatccattctatcctttttctttctaataaggaagctgcctcttctttcccaggctaatccctgcctctgtgcagtggcctccaccctctcctgctttcttgggaacactgccctgcgggttactttttctttcttttgtatattcaacttatcattgcatccggtttttaaaatctgaagtccctgccattacaaaataaaataaaataaatccttccccatcctaaattcctctctgctcccatctgactttagaacagctctcacccagatttccaatgaccaccagtcacaaagtcaaatgggaaattctactcatttgctccgtcccatagcagagttcaacactgttgtcaactccctgccactctctctctttttaaaaattaaaaaaaaaaaaattatttttggccaggcgcggtggctcacacctgtaatcccagcactttgggaggccgaggcgggcggatcatgaggtcaggagatcgagaccatcctggctaacacagtgaaaccccgtctgtgctaaaaatacaaaaaattaggcatggttgcgggtgcctgtagtcccagctactcgggaggctgaggcaggggaatggcgtgaaccccgggaggcggagtttgcagtgagccaagatcgcgccactgccaccacactccagcctgggcgacacagcgagactccatctaaaaaaaaaatatatatttgtagaaacttttaaatattcacaacagcaaaaaaagcagtaaactagcacccccaggtgcctgtcaaccagtttatcaattttcatatattgccaatcctattttatgagtgtgcacacaaacactctccctatttttgttttgtttgtttttgctggagtattttaagccaaatcctagacataatgctgtttctcccatttatactttagtatgtatctgtaaatgataaacttgcttacctgtcaggcctctgagcccaagctaagccatcatatcccctgtgacctgcacgtacacatccagatggctggttcctgccttaactgatgacattccaccacaaaagaagtgaaaatgccctgttcctgctttaactgatgacattgtcttgtgaaattccttctcctggctcatcctggctcaaaagttcccctactgagaaccctgtgacccccactctacccgctagagaacaacccccctttgactgtaattttctttcacctacccaaatcctataaaacggtcccacccctatctcccctcactgactctcttttcggactcagcccacctgcacccaggtgattaaaagctttattgctcacacaaagcctgtttgatggtctctttacacggacacgcatgaaatttggtgccgtgactcggatcgggggacctcccttaggagatcaatcccctgtcctcctgctgtttgctccgtagaaagatccacctacgacctcaggtcctcagacccaccagcccaagaaacatctcaccaatttcaaatccggtaagcggcctctttttactctcttctccaacctccctcattatccctcaacctctttctcctttcaatcttggcgccatacttcaatctctcccttctcttaatttcgattcctttcattttctggtagagacaaaggagacacgttttatccatggacccaaaactccggcgccggtcacagactagggaaggcagccttcccttggtgtttaatcattgcagggacgcctctctgattattcacccaggtttcagaggtgtcagaccacgcagggacgcctgccttggtccttcacccttagcggcaagtcccgcttttctggggaaggggcaagtaccccaaccccttatctccatgtctctacctcttcttcgcctttctggggggcaagaaacccccaaccccttctccttcacccttagcggcaagtcccacttttctaggggaggggcacgtaccccaaccccttatatctctgcatgctgatcccttatttccgtgccccaaccccttatatctctgtgccccgatcccttatttctgtgccccaaccttgtatctctatgccccgacccctttcccgcttttctggagggtaagaacccccgaaccccttccctccatgtctctactctctcttttctctgggcttccttccttcactatgggccaccttctaccctccattcctccttcttctcccttagcctgtgttcttaagaacttaaaacctcttcaactctcacctgacctaaaatctaagcaacttattttcttctgcaatgccacttgatcccaatgcaaactcgacagtagttccaaatagccagaatatggcactttcaatttttccatcctacaagatctaaataattcttgtcataaaatgggcaaatggtctgaggtgcctgacgtccaggcattcttttacacatcagtccctctctagtctctgttcccaatgcaactcatcccaaatcttccttctttccctcccacctgtcccctcagtcccaaccccaagcatcgctgagtctttctaatcttccttttctacagacccatctgacctctcccctcctccccaggctgctcctcgccaggccaaggtaggtcccaattcttcttcagcctccgctcctccaccctataatcctttatcacctcccctcctcacaccgggtccggcttacagttttgttctgcgactagccctcccccacctgcccagcaatttactcttaaaaaggtggctgaagctaaaggcatagtcaaggttaatgctcctttttctttatcagacctctcccaaatcagtgagcgtttaggctctttcatccaatatgaaaaacccagcccagttcatgactcgtttggcagcaaccctgaaacactttacagccctagaccctaaaaggtcaaaaggccgtcttattctcaatatacattttattacccaatctgctcccaacattaaataaaactccaaaaattaaattccggccctcaaaccccaaaacaggatttaattaaccttgccttcaaggtgtacaataatagaaaaaagttgcaattccttgcctccactgtgagacaaaccccagccacatctccagtacacaagaacttccaaacacctgaaccgcagtggccaggcattcctccagaacctcctcccccaggagcttgctgcaagtgccagaaatctggtcaccagaccaaggagtacctgcagcccaggattcctcctaagccgcatcccatctgtgcgggaccccactggagattggactgtccaactcacctggcagccactcccagagcccctggaactctggcccaaggctctctgactccttcccagatgttcttggcttagcggctgaagaccgatgctgcccgatcgccttggaagccccctagaccacggacgccgagcttcgggtaactctcacagtggagggtaagtctgtccccttcttaatcaataccgaggctacttactccacattaccttattttcaagggcctgtttcccttgcctccataactgttgtgggtattgacggccaggcttctaaacctcttaaaactccccaactctggtgccaacttagacaatactcttttaagcactgctttttagttatccccacctgcccagttcccttattaggcagagacactttaactaaattatctgcttccctgactattcctggattacagctacatctcattgctgcccttcttcccaatccaaagcctcctttgcgtcctcctcttgtattcccttaccttaacccacaagtataagatacctctactccctccttggcgaccgatcatgcacccattaccatcccattaaaacctaatcacccttaccccgctcaactccaatatcccatcccacagcatgctttaaaagggttaaagcctgttatcactcacctgttacagcatggccttttaaagcctataaactctccttacaattcccccattttacctgtcctaaaaccagacaagacttacagattagttcaggatctgcgccttatcaaccaaattgttttgcccatccaccctgtggtgcccaacccatacactattttgtcctcaataccttcctccacaactcactattccattcttgatcttaaagatgcttttttcactattcccctgcacccctcgtcccagcctctctttgctttcacctggactgaccctgacacccatcagtcccagcagcttacctgggctgtgctactgcaaggtttcagggacagtcctcattactacagccaagctctttctcatgatttactttctttccacccctccgcttcttaccttattcaatatattgatgaccttcttctttgcagcccttcctttgaatcttctcaacaagacacttctgctctttcagcatttattctccaaagaatatcaggtatccccctccaaatcccaaatttcttctccatctgttacctacctcggcataattcttcataaaaactcacgtgctctccctgctgatcatgtccaattaatctcccaaacctgaatcccttacaaaacaacaactcctttccttcctaggcatggttagtgcagtcagaattcttacacaagagccaggaccacaccctgaagcctttctgtccaaacaacttgaccttactgttttagcctagccatcatgtctccgtgcagcggctgctgccaccctaatagttttagaggccctcaaaatcacaaactatgctcaacttactctctacatttctcataacttccaaaatctattttcttcctcacacctgacgcatatactttctgctccccggctccttcagctgtactcactctttgttaagtcccacaattaccattgttcctggcccggacttcaatctggcctcccacattattcctgataccacacctgagccccatgacggtatctctctgatccacctgacattcaccccatttccccatatttccttctttcctgttcctcaccctgatcacgcttgatttattgacggcagttccaccaggcctaatcgccacacaccagcaaaggcaagcgatgctatagtacaagccactagctcgcctcttagaacctctcattttctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccccgagtcagataactaaaatacttcttagtctaggtagacactttcactggataggtagaggcctttcctatagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaggaaaagtagaacggactaaaggtcttttaaaaacacacctcaccaagctcagccaccaacttaaaaaggactggacaatacttttaccactttcccttctcagaagtcagacctgtcctcaatgttacaaggtacagcccatttgagctcctgtatagatgctcctttttattaggccccagtctcattccagacaccagaccaacttagactgtgccccagaaaaacttgtcattcctactatcttctgtctagtcatactcctattcaccattctcaactactcatacatgccctgctcttgtttaaactgccggtttacactgtttctccaagccatcacagctgatagctcctggtgctatccccaaactgccactcttaactcttgaagtaaataaataatctttgctggcaggactatgctgaatctccttaggcactctctaatcagatgtcctgagtcatcccaattcttagaccttttatacctgtttttctccttctcttattccatttagtttttcaattcatacaaaactgtatccaggccatcaccaataattctaaatgacaaatgtttcttctaacaaccccacaatatcaccccttaccacaaaatcttccttcaccttaatctctcccactctaggttctcacactgcccctaatcccgctcgaagcagccctgagaaacatcgcccattatctctccataccatcccccaaaattttcgctgtccaaacactttaccactatttcattttatttttcttattaatataagaagacaggaatgtcaggcctctgagcccaagctaagccatcatatcccctgtgacctgcacgtacacatccagatggccggttcctgccttaactgatgacattccaccacaaaagaagtgaaaatggcctgttcctgctttaactgatgatattgtcttgtgaaattccttctcctggctcatcctgactcaaaagctcccctactgagcaccttgtgacccccactctgcccgtcagagaacaaccaccctttgactgtaattttcctttacctacccaaatcctgtaaaacagccctacccctatctcccttcgctgactctctttttggactcagcctgcctgcacccaggtgattaaaagctttattgctcacacaaagcctgtttgatggtctctttacacgcacgtgcatgaaattaccgttaactacaaaatgaatttcataaaaattaacaataatcatttttaagtgaatttgagattaactgaaaaattaagtcatttaaaaatatcattttatattcaagttgtattgaaatttcccagattgtctcaaaaatggcttttggcagttaatttgtttaaattgggatccaagcaaggtccacacactgtgtttgattgacatgttcctaaatctcttcctctgtagcagcttcccctctcgcttcttccacactaattattaaataaaccaggtcaatcatcctataaaaatgctcacataaaactgatggaattcccttggtatcatttaaagtatttctctatcttgtatatgtactgtaactagtagttcgtttgagaggcttggtgagattcaggtgtgtcttcattaggccctggggacgggccgcatgcctggtagcctacagccctggtaattttcacaccttgcttactgctctcaagttagctgcagactcccttttttttttcttaaaggactatgtatgtaatagcattttacacatttgaaaaggctataccaattcaaattgtaggtaaaatagagtatcgaatggcttggaatctggttgctcaatggcaggctaagaggagaaaggtacctgggagaatgtttacaagggtttgtgctccaggactggaggaaagaaaggggcaaatattagagttgtgtaaagatccagttacgtcagaagcactgacctctgtactatgcctagggctaggggaaataaagcagaagctaaaggaagattctgacaccgggttgagttgcatggctatttatttccccaggctcatcattgatggcagtgatgggagtgaataatagaaattctcctgttcaatacagccttcagattttgttgactctggaactctccagaacaagcaggggggccttaggaacaggagaataataattcatgccaagttattgtttctcagtcttttaaaacctaagctcatgttagataaacaaaaaattctcatgtccctcctggggtcttctccacttggtaaaagcaatcttttctttcatagaccctctggccaagaagattttgtaaatcttcactttctgtagattgtgtaataaaaatgatagatgtagcttgtgttgtgttgttttatactttttcccaaaaatacatacttataacactagatgggcttctttcttttatgcttgcttttctgtgagttctgccctatgggatttgagtgttatactcaggagagtagagtctaccagattttattccaataagggaggccaaatgtctatatagtcagggccaaagatttttggcagatgttttcttccttatacagcctattttctatgtttgagttttgcaaacatttagccttcacatactcatatatttctctttacttttataggcttttctcccattcatttacttaacaaacatttattgagttatccttatgtgccaagcattgtgctaaataatgaggctatataataaaaagatatatagtccctattctcaagggacacacagcattgaagagggcacaggagaggagatcactgattttaatactgcatgacaaggattataacagaagcagacacaggggtgagagaagcacagaaaagaaccagctttctcagctagtcttaagacctttgctctccacacattgatctcctatgggaacaataactacagagagagaaaacagtgggttttcttttctgaattctgtggttaccacacatatgttgtcataagcaatctcactttggaattcagagtactttatttttctggaagctatggtcctggagaatagaactgacatttcattcatccgtacacacatacatctacccatcaaggatgtattgactgtcatctgaagccagagaagcagtaatttccttgagggtgctagaccaagggagcacaggccatgcccaatagatttaggacaaatccaaccagaccatgactaacccactcacctcaggctcctctcggacacagtccagtggccctaactgggtcaattgcagaacagtgtccattgagcatgaagacagatgcaattaccaaactttaatccatcatttaggaataatcacagcaaacctaacatttaaaataacttaaggctagaaacgtgagtgtgtgaaggaagaaaaaaaagtcacttaaagataaagaaaagagcatattggcagcgggcaatgcttcccgacggttcctttatgtcagacaagactctcacactctttattcaactaagaactcggtccagccgggcgcggtggctcacgtctgtaattccagcactttgggaggccgaggagggcggatcacgaggtcaggagatcgagaccatcctggctaacacggtgaaaccccgtctctactaaaaatacaaaaaaattagccgggcgcggtggcaggcgcctatagtcccagctactcgggaggctgaggcaggagaatggagtgaacccgggaggcggagcttgcagtgagccaagatagcgccactgcactcaggcctgggcgaaaaagcgagactccgtctcaaaaaaaaaaaacaaaaaacaaaaaacaaaaaaactcaatccaagtcgctatattgcaagtgtgggaaaagggaagagagtgattctcatctggcttaaaaatgaaaatatatgcgtatatatatagcttctggagagcagaaaggaatttaaattttatttctacagcaaaacatttttaagtcaaccaatcagaattagacctttcataagatgagggctacattcatagactataacgtcaatatctaaagtccaggtgttttaccaaagtctttttagcatttggaaatagcacttacagcaacatttttattatgcatgatgccatttactttttctctgaagctgcaggggaaatatgcaacatttcctgtcttatttacagaagtttctttcaccagcacttacaaaggcccatgaattttcgaggccaaaaactgtaattccattggttatcacagagagaaagaaacaggcccaaggcacccaaaacaaaaaacttgaaaaaagaaaaatgcaaaagacaaatggaacatttggccggaagacaaatggaacatgttgatattttgtaccagcaatgcagatgacattttctgaaatcttagaaacagaagtttatttctgtttgaacttccacaatatcttagaatctaatatagtgaatagagcatagaatggtgaattaagaggatctgggatctagttctgattccagcatcaattaatgaagtggacttgagcaaatctattctcccctttaatcttcagtgtatccatctgtaaaacgaagataacattcatgatttctggggttactttcttattgtgaaatccttgaggaaaattaggttacagaatgtgtacaggaatgactggatagatggatgaatgaatgaatgactcagtcaatcaatacaaaagaagctttggattttcatgtgtggtcataattctccccaatcatatgcagctataattacatatttttatgttttagtgatgtttactgattgcaccaaataaattctaattttccaaaagtttgatttgtctttttattgtggaaagccttagttgactttaatagatttattacagtgccctctagtggaagaatgagcatattgtgtcatcctgccgctgcttagtaatcaacaaacctctacatttcacacatttttaatgaatcaaacctctatgcttcttgcagtgaaattttcagttttcaagatctcacttggattaaaattctggtttataaccaatcttgaaatttagcaacaacaacatgtattaaggtagaatatcattttttaaaaaaaccctctcctaattattgactgatgctcttggagtaagtgtacattgggctatataaaacataaaggacaaacctcaatgcgttctccaaatgcatgaattacaaccaggaaagaaagaagattctgatatcctgaactctttgctggtttaccatgtatgtttctgtcacatgtttcaggtgggacagggacagtacccgtggaacgcagaagaggagcaccaggatggagaaactctagcctcaccgactgtttaggttgtgagagcacacggggcatgtgctgtgggagttcttcagctatctgtcctcaggttacatgggaacttaccatcttactcactggcctcggcttcaatgtaattgctgttggtgtagtaatcaatagacatttctccccagaaattgaactttcctcttgattgaccagcaactgaaagcatatgagggaaatatttaagctctgcctacaaaccaatttcacacaattaactggtcagttttgtttttaaaaagtgacaaaggcattttagtcaagcaacaaagatgatgttttaaagcagaatttctccagttactgatttcaattttaatatatcaacataccagataccaacataccaaaatataacattggtttgtatgtacagagagtgttatggagtaaataaaaagctaaaaagagatgtgataacttgaattccataggattgaataattaccttaattagtaccttctaggacaacatctgatgtgattagtttctataacaactcttcatgttaaatttagatcactcctcatagcaaaaggataatagaaagttctatgtcaactggcttaaaaaatatatttgcattttttaatgtaactatggaaaaaaatccatgagtaataaatctttggggtgctgaaaattcttgcattgaacagagcaaaatcctgccatctctctagcttttgtcacctgagtaaatcacgtttccagaggttccctatatctttaattctaacacttcatattctttttccctatttacatcattggcaacaggataggctcctaccccactgaggaggataggaggataaatgagaacaatgggtgaatcacaggtgagcaaaaacagtgagcactggaaaatgtatgacactaatatactcagtgtagtccaggctaatttctaggaaggaagccccttaggagaggggctgccacagtttactttaatttaaacttctttttattgaagtgtaatatacatacaacaaagtgcacaaatcataagtgtacagctcaattaattttttttttttttgagacggagtttcgctctgtctcccaggctggagtgcagtggtgtgatctccactcactgcaagctccgcctcctgggttcacgccattctcctgcctcagcctcccgagtagctgggactacagtcttcctccaccacgccccgctaagtttttgtatttttagtagagacggggtttcaccatgttagctaggatggtctggatctcctgacctcgtgatccatccaccttggcctcccaaagtgctaggattacagggatgagcctgtaatgcaatgcaatgagcctgtaatgcaaacgcgcgcggttgcattaaattttaatataaacctagggatggaattgcagatttatgaagcatgtacatattcccctttagtaggtactgtcgagaagctctctgggtgggtgtagtcatttaaactcccatcagcagtgctgaggggttctttttgtcccacatcctcaccacatttgatattgacaatccttttaattttagccattctggtgagtgtgtagtgatatctcattttggttttaatttgtttctttgatgacaaatgatctacagcatattttgacaaatgagctacagcatatttttatatctttataggacatttacatgtccttcgtagtagagtcattattaaccttttatgcccattattggtttctcttttccatctttttcttattgattggtaggaattctttatatattattaatatgactcctttgttggatatatgtattgcaaatattttctccctgtctgtatcttgccttttgccttttcatgctcttaatagtatcttttgatggataaaaattcttaattctaatccattttaagtttgatttatcagactttcccttgatgattagagttttatgttctgattaagaaataattttaccaattaaattcatgcggatattttcccatgttatcttataaaagctccagtgttttatttttagaaccaagcaattaatgtttgtgtatggtatgaggcagggtgaagacccatttcaattgcatatctagtggatccactttttgaaaagatcatttattctgtcgctgaattgcattggtactttaacataaataagatggtttgcatttttatgggtctgcttctggactcttctatttcatggatcttttggtctaccattgtgccaacaccatacagttttaattactgtatctttataattaatatctagatctgacaatacaagtccttccaactttaaaatattttttcaaggtcgttgttattctttccctttcctatttccaaatacgttgtttgggacaagttaacatgcttacaatattgaccctttcaattcataatcatgatatatccctccatttagttattcttcttattttattttaagttccagggtacatgtgtaggatgtgcagatttgttacataggtaaacgtgtgccatggtggcttggtgcacctttcaaccaatcacctaagtattaagcccagcatgcattagctatttttcctgatgctctctctcctccaactgcccccgcatcaccgacaggccccagtgtgtgttcttcccctccctgtgccatgtgttctcattgttcagctcccacttatgagtgagaacatattgtgtttggttttctgcttctgcattagttcgctgaggataatggcttccatctccacccgtgtccctgcaaaggacatgatctcattcctttttatggctgcatagtattccatggtgtatatgtaccacattttctttatccagtctatcactgatgggcatttgggttgattccatgtctttgctattgtgaatagtgctgtaatgagcataagcatacatgtatcttttttttgtttgttttttgagatggagtctcactctgtcccccaggctggagtgcagtggcacgatctcaactcacttcaagctctgcctcccgggttcatgccattctgctgccttagcctcccgggtagctggggctgcatgcacccgccactacgcccggctaattttttgtatttttagtagagacggggtttcaccatgttagccaggatggtctccatctcctgacctcatgatctgcctgcctcggcctcccaaagtgctgggattgcaggcatgagtcactacgcccagccctgcgtgcatgtatctttataatagaatgatttatattcctttggttatatatccagtaatgggattgctgagtcaaatggtatttctggttctaggtctttgaggaattgccacactgtcttccacaatggttgagctaatttacacttccaccaacagggtaaaagttgttcctgtgtccccgcagcctcaccagcatctggtatttcttgacttttaataaaacaaaaatagccattctgactggtgtggtttttatttgcatttctctaataatcagtgatgttgagcttttttaaatgtttgttggctgcataaatgtcttcttttgagaagtgtgtgttcatgtcctttgcccactttttaatggggtgtttttttcttgtaaatttgtttaagttccttatagactctggatgttagacctttgtcagatggataggttgcaaaaattttcttctattttgtagattgtctgttcattctgatgatagtttcttttgctgtgcagaaactccttagtttaattcgatcccctttgtcagtttttgcttttgttgcaattgcttttggtattttcatcatgaaatctttgcccttgcctctgtcctgaatggtattgcctagattttcttctagggtttttatagtttggggttttacatttaagtctttaatccatcttgagttaatttttgtataaggtgtaaggaagggatccagtttcaattttctgtgtatggctagccatttctcccagcaccatttttaaaatagagaatcatttccccattgcttgtttgtgtcaggtttgtcaaagatcaggtggttgtagatgtgtggtcttatttctgagttctctgttctgtttcattggtctctatgtctgtttttgtaacatgaccatgctgttttggttactgtaaccctgtactatagtttgaagttgggtagcatgatgcctccagctttgttctttttgcttagaattgctttggctatacaggctcttttttggtttcatgtgagttttattttattatttatctatttatttattttgagacagagtcttgctctgtcactcaggctggagtgcagtggcacggtcttggctcactgcaacctctgcctcccaggttcaactgattctcctgaccctgcctcccaagtagctaggattagagatgcacaccaccataccaggctaacttttgtatttttaatacagatggtgtttcaccatgttggccaggctggtcttgaactcctgacctcagctgatctccccaccttggcctcccaaagtgctgggattacaggtgtgagccaccacacccagccccatatgaattttaaaatagtttttttctagttctgtgaagaatgtcaatggtcgtttgatgggaatagtatttaatctatgtattactttgggcagtatggccattttcatgatattgattcttcctatctatgagcatggaatgtttttccatttgttgtacactcactgatttccttgagcagtggttggtagttctccttgaagaggtcttcacttcccttgttagctatattcctaggtattttattctctttgttgaaatcgtcaatgaaagttcattcatgaatttggctctctgctgtctgttgttgttgtgtaggcatgttagtgatttttgcacattgattttgtatcctgagactttgctgaagttgcttatcagcttaagaagcttttggactgagacagtgggcttttctagatataggatcgtgtcagctacaattctaagagctttgggcattttctgattgagttttcatgacaaccctatgaggtatatacagatgaggcacctgagactcagagagattaagtaactagccaaagatcagacagatggttaatggcagaaacagggggcagacccaagcagtctggccccagtgtcagtggtactgcaaaaaggtgaatgttttacacattgtggaccacaagagtgataagaaccaaaaaaaatctggaatctgaccaaatagagcacagggttttactaaacctaaaatgagggttcaccatttctagttgccatggcaatgaaccgctttaatgacaaggcaggcaaaatgaggggtgggggaatgatgtgcaaatgaagtaatagtagtaaggcagagaaactaggggagtgaaactctacttggggggaagtttgtggatccatttgggaaagaatctgctgccaacatgtcatagcagcatcatagggaagcatttgcgttctaaataatggaactaaatgaatggtgatgctccaaaacacatatctgtatatctattgtctctctcactggtttggtcaacagagagtcaataaatcaaagagtgaaaacccacagggtctgattttttctacctgtcatcatttgtatcttgataggatgactgtagaactcattctccaggtgccctatgcaaactggcttttggaggctctccctgccatggcactgggtgcctgtgcggttaaatggtaatatttgctgaagaaaaatgtatgctttcaattttatttttcagagacagggccacactctgtcacccaggctggaatgccgtgacatgatcatagtgtgtccagaattggttccttccggtgggttcttggtctcgctgacttcaagaatgaagccacggatccttgcagtgagtgttacagttgttaaagatggtgtgtccagagtttgttccttcagatgttcagatgtgtctggagtttcttccttcctgtgggttcatggtcttgctgacttcaggagtgaagccgcagacttttgcagtgaatgttacagctcttaaaggtggcgcgtccagagttgtttgttcctccctgtgggtttgtggtctcgctgacttcaggaatgaagctgcagaccctcgcagtgagtgttacagctcatagagagcgtggacctgaagagtgagcagcagcaagatttattgtgaagagcaaaagaacaaagcttccacagcgtggaaggggacccaagcgtgttgctgctgctgggttgggtggccagcttttattcccttatttggccccacccacatcctgctgattggtccattttacagagtgctgattggtctgtttttacagagtgctgattggtgtgttttattgagcgctgattggtgcatttacaatcctctagctagacagaaaagttctccaagtccccacccgacccagaagcccagctggcttcacctctcaatcccccctctaaacaggacaccccaactgctgttgggaattaggtggtgactgctctagctacttcctgctggatggggcaaagaaggggccctgcagatgtagtgtcctccagaggggaactctttaggccagtggaagggccagcaggttggtccaggggtcctcggtagaagttgttaattgagctcatttggggttccatttgtaagaccatctgtagcttgatggcattgatcctagaggaaacaaatttgacaaggaggttaaaaatacagggcctgaagatgagtaatagtaagatggctgtcatgggacctagaaaggggagaagccatgttgcctaacttcagaggttggtataagagtttgaagagcattgtctgatttcagaagacttttcctgtaaatgccgggcagcgtcttgtactatccctgactggttagtgtaaaaacaacactcttcccctaagaaggtgcagagtcctcctttctcagcagtgaggaggtctaggcctcggcggttttggagagtcactgctgccaaagagtctatttgggattatagagtaaggatagattatgttatttcttgcaaactgtctgagaaatcctttgagagcatgtggtaggaggataatacatgttacactgttagcaaactttacttttgttgaaaaccttgtaagcttgggatttcaattattctttgctattaataagacctcattcagtccatattaacttagaattggtatagatggcttcttcctgattctgtaagtactttaatgtttggctgagtgcaaacagttcgcacatttgagcagaccaattattaggcaattttcctaactctgcttctataagattttccttatcacttactgaatacccattgtgtctttttccctcaatcacctgggaggaaccatctattgtcctgtcctgaagggagttcttcctaggtctggtcagacctttgtatggtaattaattaagatttagatcccctgttaggaaacctgctgggttaaggatttttgataggaaggttacgggttgtcagtggcctcagtgcttttgggctacatttacactgacaacaaggtggtattggagtgtaatacggtcacggagaagaccttcaattatcaattataggttttaaatttaccctggcttttaaaggaatagggtacactgttttttctttactacttctatctctctttctttctctttgacttcttctttgtctctttctctctttctgactccctctttgtctgtctcttcctctctctttgactgtctctctctttctctctctctgactccctctttgtccctgtctcttcctctctctctctttctgactttctgtctctttctctcttcctctctgtctgactccttctttgtctgtctcttcctctctctttccttctctttctttgactttgtctttctctttctgcctctctgactccctctttgtctctctgtctcttcatctctgtctctttctctcattgacttcctgtctttttctctctttctcactctctgtctctgtctctctgtctctgccagccgcttatgctgctgtttccacgtccttgggtttttgcactgtgtgcaataactccatggttgccttgtgatatttaatggagtttcccccagagcttaggaactccctttctttccatattgtagcatgggcatgtaggattagataagcatgcttactatctgtaggaaagtctcccagttacaactgaggaggtgggagaaatacctggttacaggctgtcccaggattcctcggatggtaacggaccttgaggacagctgtctgggacaagagtttaacactgagaaatccgcaccagtgtccaggaggaagtcaattttctggccctcagtggttaaacatacctggcactcagtgagggtgatgaggtgagctggtgcttccccgggcaccctcagtcctgttattggatcatctggttgggggcttctggcccagagaacctttgtcctctggggcagtgcaccttccagtgattgcctcagcattgtggacatgggcaaggggacagcttgtttcttgttggacaatctttttttaaggtgtccttgcaaacaacactggtaacaagccctaccgcatgattggcctgctccattttctctgaaccagcaaggtttgtttgtttgtctgagggccatgactaaggctacggactttctctgatctcgcttttccttttgggcctcttccttttggtccttattatagaacactgaggtttccaggtttaataatgcctccagattttgttcagggcccagggctcgcttttggagctttctcctgatatctgtggctgattacccaatcagaataaacttatcttttaggatcaattgaccctcaagtgagtcaggtgatgggagtatattttcttaaggcctcctatagccacttgaggaaggcagaaggattttcttcctttccctgagttatggcggacatcattgaataattcatgagctttttcctaattctccttagtccttctagaacacatgtcaacagatgtttacgactccagtccccatgatctgagtcaaggtcccagtggggatccatactggggatggcttgctgactggtagggaatttgtctctttcttcggctgttattccatcatttacttgactaagataccaggtatctccaaaatctcaggctgcagctaaagccacattcttttcattaaaggccagggtttgatctaacaatagcatgacatctctccaggagagatcaaaggtttgccctagaccctgtaggacaactatatacctatcaggatcatctgaaaacttccccagatctaccttgatctgctttaaaacagagagggagaaggggacatgtatgcagattaggccaaattccccttcccctacagcttgaaggggacataactgacagcccagggatttttgtggtcctttggagatttctttgcgtgtttccttctgggagggggagattagaggaggcttatcattaataggaaggggagctatgggggtaagctgagaggtcctcctgtgggatgtaaattgcaagcacaactattctgaccagcagggtccagggaccgttgcatcttcttggataagaggtgtttctgctgctgcatcagtgagcgcaactattccgatcagtaggatccagggactgttgcaggttcttgggcagggggagaaacaaaccaaaaccgtgggctgttttgtcttttagatgggaaacactcaggcagcaacaggcttacccttgaaatgcatcctaagccattaggaccaatttgactcgcacaccctgaaaaagaggtggctcatttttttctgcactgtggcttggccccaacattctctctctgatggagaaaaatggccacctgagcgaagtataaattataatactatcctgcagcttgaccttttctgtaagagggaaggcaaatggagtttatttccaagctttcttttcattgaaggagaatcccctagttggaatagttgcactcaccaacgcagcagcagaaacactagttttcctcctagaccacaaggagggccaaggaatgtcagatttagtggcccttatggccgcattctcgaaaacctgttagagtcctaagcattctcctgttagtgttgggacattacccctgtcctataaagatgttatgccctaaaaatgaaatggagggccataccctgagggagggaaggcatctccagagttggaagagtgatgccttttgtcctcacttatatgaataggaaagataccatttctgaagctccccatatcctagcttcaggaatagcttttattaggcctgctagtctcaggagggatcctaaaattccagatagtaatccccactaccaatggggctttgggcaaaaattgtgtctttctgattggtgagcctgagtgcctaaagaagggaatagagtcctgaggtttatactagaaatcacacttagaggagaaactacaaaagcaccagagacagggagtggtttttggaagcgggacttgtcgcggagaagagaggcgagaggaagtttgtctgacaggcattaggacccaggaagcaagggtcaggatagataagataggtgggcgagtctcacttgggcaacgtaactttgagagttctgcttacggtcgcagggtcaaccaacttgttgttgggaccccggagctgaatggctttcctctctgtcgaccctcagctcagcccagaagtacaggaaaagcggaagctggttccaggcaaaccaacgctcccaactccgaagagtcaggggttgttacagagccctttcccagaaagtctgacacctgtctttagtgcggccgccgtgctaatcacttttaactggccaacaggtgcccggtatttagcccccgaattgtaagtaaaaataggacagaatagcaagcgaaaggggtggtgctcactgcttggcaatagtcccatctgggtcgccaaaatgtgtctggaatttgttccttccaatgggttcttggtctcgctgacttcaagaatgaagccacggacgctcgtgctgagtgttacagttgttaaagatggtgtgtccggagtttgttccttcagatgttcagatgtgtctggagtttcttccttctggtgggttcgtggtttcgctgacttcaggagtgaagccgccgaacctcatagtgagtgttacagctcttaatggtggcacgtccagagttgtttgttcctcccagttggttcatggtctcgctgacttcaggaatgaagccgcagaccctcacagtgagtgttacagctcataaaggtagtgtggacccaaagagtgaacagcagcaagattcattgcgaagagcgaaagaacaaagcttccacagtgtggaagagcacccgagcgtattgctgctgctgggtcaggtggccagcttttattcccttatttggccctgctcacatcctgctgattggtccattttacagagcgctgattagtccactttacagcgtgctgattggtgcatttataaacctttagctagacacagagtgctgattggtgtgtttttacagagtgctgattggtgcatttacaatcttctagctagacagaaaagttctccaagtccccacccgacccagaagcccagctggcttcacctctcaatagctcactgcaaccttgaacacctgggctcaaatgatcctcccatctcagcttcctaggtagctaggactactggaacatgccaccatgtccatgcatctgactttttaattttttactattttgtaaagactggatctctctaagttgcccaggttggtctcaaactcctgacctcaagaaatcctcctgacttggcctcctaaagtgctgggattacaggcgtggcccatcacacctggccaaaaaaaattatatatatatataatttttgaactaaatattgaactcaatattatatatatatataattttttatatattttacctaaagaatatgccttttgtgttttcaatttgtggcttgatttttccaaaacatattaacaagaaaatggaataaatatatatatatatataattgtttaactgcacttagaaaatggaagtaaaattttttaattaaaaaaaaatattaccaatggtatggagagaaataaggtgggaaaagacagagaaagcctgacttttctgaatctactttgttttgtagatttcattttggaaacatgtaggtattttacatgattatataacaaaataaactaatagaaaaaaatccctaaatattggactcaatatgaaataaatgaacttcagtgtgtatctggctgatttgcataatcacataaacgactgcaagtgattttatggcagtcatttgatttatatccccagtgggataacctgaaggataaaaagatctgcgaggaaaaaccacataaactctttccagtatttatattgttgttgctggtgttgatattgccattttgagactgatgcctgtgttgttattttgagacgattgtaggataaaacaaatgaaaattaagttgatgtcattgagaaccagtacttctggcatggaaaaaaagggatatacagatgcaaggttaatgagattacataaaatcctttagtactgaagtggaattccagtgggaactcataatccattttttctttttctaaaataaaaagcttttgtacagtctagaaacaataaccagtccagtactgatgaacaccctaacacccaaattgtgacctccacttgccatttcccaataaaaataaccaaagcttcttagagaaatggctgacttcagattgaagatgaggccagcacatcttgtctgacctgaaagcaaactgtcaaggattacagggtcatgttaaagagactaaggagctgacttaaagaggctcatacttattgcagatgggacgctatgagcatcaataaatcatcaataaacagtagttatatggcaatggccacagatggaaacatttaaaaatttgtttactcataagttcaaaacgatactagaaatcaaaacaaaaagtttattcatcacctttggaggatgataaactcattactttgaaaattggcaaataaatggtaaatcattgatcctgtttttcctatatgaattgtaactcacagtaattagttattaaagaggcaagtaatagtaaatagagaggcaaattcctctttatagaaatattctagctaatacatgaaatagaaattacataattaggattccattattttcaaaccttaaagaattatagtatctaagcaatgattatcattggctactaacatcacaaaaagagagacaaccagatatctggatatcagagtcgtgaaatacactacctaccattgctgcatagaatcctaaggaggagctttgacaaacagcttcctagttatcttactgggaatgattcagatttcagttccccccagtagatgtctatcattgtttcccaaatttgtatgtgcatctgagtaatcaaagaattaaaaaaaaaatgaacccaaaatactgcccctgatcatgtgatctaatagatctcagttgaggaattgattttataaaatttcacaggtatttctgatgttcatccaggtaagagaaccattggcctgtcttttattgtccccaaagcctcatctaataccctgtatggagcagactataggcaggtaaagccttgggatttttggagaatccatcaaaaggctggtatcttcaatcactcctccaccttattgctggcaccttcaattccaccatcagcatttaaactgtttagctttttactgtcaaaataacccactaaagacgggaatggaaaatgcatagccaatgtaataccattttttactcccaaccaatggccctgcgactaattgatcaacgtcctcttcccactgaaatcaaatgtgacctcagattccttctcactccaatgatctgggcagttacaaccagttaattattattgacacacaaaaatgatttgtcatcctccgctcgggtgttactattatcccctgtgcactttgagtaggcggaaaaaggtgatttgtttgcatctccttaacatgcactaagggcctgagagtggcaagtgatgataaagtgagaaatcacgaacacttcctgtatctcaggctgataatggcgcgtgtgttcattacttcaacaggtatttatagagttgctcttgtccaggccccatgtttggcagcagggttcaaaagaagaaaataaacatggccctcagctcgtgaggttcactgtcccacacttcacagagagggttccatcaagaggtgagcatttagcttggaagtttcagaggaatgaaggaatgaaacaatgttgtttgcaagcacttgacaaataggaaatgtaacatttactatcatttccttggaacccctgcttccttcttaacaatgtgctctgaggatggaatctatcctttggcctcagcaagcattttacttagtagcaagccttctcagctgatgtcttctcgcaccatttgtgggtttattcttcaattgagctcgttaatttgcacaatttcttgttactcctgtgtttgtttcctgtgtttgttacatccccaattcactagaaagaatcagtggctccaaagttgttcagtgagaggggaaatcagagatgacaatagcagcgtaagtaccaggcacagaagcgtgtaataaaccaaaacccagccttggctcaaatgaatctgaaagcatgagagaagccaactgaacagcaaaactttttccatcttccttcaggtctatagtgtgtaaacatttctccagcagtagcgtcaagtttttgacattctcatgacatttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctctcatgacatttttaagcaaaatgtggtggcctcttgattaagtgtatttatttatttatttaattaatttttgagacagagtcttgctctgctgcccaggctggagtgcagtggcccgatcttggctcactgcaagctctgcctcccagattcacgccattctcctgccttagcctcccgagtagctgggactataggcgccccctaccacaccgagctaatttttgtgtttttagtagagacggggctccaccatgttagccaggatggtctcaatctcctgacctcatgatccacctgcctcggcctcccaaagtgctgggattacaggtgtgagccaccacacccggcctaagtgtattattttttaaacaagcagaaaacaataccttccagaattaggtttataaataggatatgagttcaagagtacacaggcatcattcaatgttgcagcccttatggcaaaaacaggtgcaagtcgcagtatcgcagaggagcttgtaaaaccagtctcaaagtcagtgacaaatatttttgagaaaacagaataagctatcggttaaatgccttttcagatgaagctgttggatgttgcatcatatcactagtataccatgtggaattactatcacttgtgcatgccaacaggcttatacagttgtacaaaaccatcgatacgtaaagtagcacgagggagaagtgtgatgaccttttgtcctctgtattgtggaaagcccatgccaaaaggagcaaagatttccacctagctcaatggttggtgtgtgagccataagataaactggaagaggtatactgggatcaatacagacaacaccagctgtgtttgcagcaaagaggctggaggacacaactgaaaaatatggcaccagaatgccagttatgcatggctgaatgtgcaaagaacagttggtctacaaaatgccttctgatcctgaaatggtgttgagaaagattgtgaaattttcgatatgacaatattgtggccacggaatatgtgtttagcatgctgtatgaagaaaagaactccagttctgaagggaagtgtgttcatgttgaagaagaaaaaagtgtgttcaatatccctgatgatgtctgttccgttatttccaatgaatgatcttagcaatagatttattttcttgaatagactgaacctctcacttcttggataaaataccacagtttttaatgctgaggggaaaaaatataatttttaagaagagaaaaatatggtgagaaactgcttgatgcccaagattggattctttctaattactcaataattttccccatttgccccctccagccctatgccctgctgccaaataggcatatttttaagaataaagaagaaacctcaatatcctcaattgaggatgttaagaatggctggattctcagatattcgtcactctctttgtaaaacatcaacaggtatctgcagcacggtgattccactgtgattcagtatgtctgtgtgttctcaaacgtatttaccacttacactgttaacataggtgtataatttaatcaaacattacaccagccaatgatataaagatatacaccagactctcttgggaagctttaaaaatcccagcccatcctccagcccaatttcaccagcatccctgggaatgggtcccaggcatcggtgttttctttagagatcttcaggtcattccaatatacagccaaagctgagaaacagagattgatcacccagctatcttaggtatggaacaaaagaaacagttggcacaaattattagtttagacttttttccttcctttttttagcatagctcacaatgaccaagctacctccatagattctcaggaattttatctctttccttttttgactccttttactaagtagtggcatttgagaagacgttgccattttaggggtctaggatgtagcctacctttatataactgcagctgatttttttctttttgagatattgtgaaaaaaaggccctgtggcacctcccatcctgatgaagtcctgaatgtgtgggcatattcagacatcttcatagctcactaagcaaatagagactactcaaaagatgcttgaagctaggcacagggtagttccaggtgctcgggaggctgatgcggaggattacttgagcccaggtgctcaagaccagctcaggcaatatagcaagaccatgctgtaaaaaattattttcaaaaaaaagaaagtcggggaaaaaattagcacagtgagggtgggactggaggacagcaccaaaggggaagatttcatgctcaggagggaattatgatacagatagatagataccgattgaataccagggtcgctgggtaggccattggtgagtgttgccaggtgtgtgggtgatgggggaatatgagggtagggagtgtagtgggaggaaataatgttcctgactgagcaaaagaaaagtgagaggagagctgagcaactctgccgtgagtccccagggcccttggggatttccactaaccaatcattcttggaatctcttttgttatcctctctggggtccagatgggaagacacaggaacaactgtttctctgcaagtccttgtttctgaggctttcaaactcatgctcatttgtccattcagcaaaagtttgcctgaggtaggagcctctttggcttatctgaaaaacagcagcgtggccagagccagagtgcaaggcagaaagtgagaagaaacgacgtgagggagcaaaacaaccaaccttgcaagccatggtaaggaacttggaacacgtcccaaggaagctgggagacgcgtggaagatcttgagcacatcctctaagttagctccctaagaggaacacctttacccttaacttttgcagagctcttcactaaagacatagcctcatttttgtgactgtgattgacgttaaaagactaatgtaaacctggtggcaatctggtgtttaaatatctgttggggatgattggataaagaaaatatggtgtatatacacaatgaaatactattcagccattaaaaagaatgaaattggccgggtgcggtggctcaggcctataatcccagcactttgggaagtcgcggcgggcggatcacgaggtcaggagatcgagaccatcctggctaacacagtgaaacgccatctctactaaacacacacacacacacacacacacacacacacacacacacaattagccaggtgtggtgtcaggtgcctgtagtcccaactactcaggaggctgagacaggagaatggcgtgaacccgggaggtggagtttgcagtgagcggagatcccaccactgcactccagcctgggtgacacaacgagaatccgtctcaaaaaaaaaaaaaaaaagaatgaaattatgtcttttgcagcaacatgtacgtaactggaggccattatcttaagtgaaacaagtcagacacagaaagacaaataccggatttacttagaagtgagagctaaataatgtgtacacatggacatagagcatggaatgatagaaaatgggaacttgaaagagcaagggagcaggaggaggtggacaatgagaaatgactgaatgctcgcaatggttgttattcagatgatagatactctaaaagccttgacttcactactgttcaatctatgcatgtgacaaaattacactcataccctatacatttatataaataaataaatacctgttgggtgttttacttaatggaccagttttctaaagaattacttccttgacacttctttgcaaggagtcttttctttcctaagtgattttgttcctaagtcatgcttccacacagcacacaggcattaacaagatccgtggagtcagaaagaacagaccctggagacctgccttccttcctgtgggcacctgtgactgatggggacctaagcaagtcaagggtgaccatagttgagctatctcaagatgtgatgtgctgtggagactggagaagaataggtttggggggcaagttcaagcagctccccatggtatgtgagtgccctctgtgtagtagccccttgggcaacttcggcctcatataaatgatatctggggacccagggagcactgggtaaatctgcactgagattttgggtttcaattgacctcaagctgcctagaaatcacaattcccgtaggtatgataactaacaatggatatattcaagtaccctaccaaatcatgaattttagataatttagggatagcaaatggagaaggatttttttctaatatagaaaagctcttttaggatattatggctatgcacaaatactatatcttcagaaatattcataaatactgcccaagccattaaggatgttggcagcccagtagattttttttttacttaaacttttaatggactttagaaggaaatcagtgaataatgaaatactgaaatactctaaactatttttctactgggaaataaatggcactctagaggcctaaataaatcattacagctaataaaatttcctgatattgcctctagtgaattttcaccaggaagattgaatttgtacagatttatacagtcaaacaaggtcagtctaggaaaggaaagctgtttatccagcatgtgggcaacataaattcagactattcattatgtaaccacacctttggtagatgccctttgtagctttcccgtgagattggagaagagaaggcttacgttgctggaaatagatatgactgctagtgagagaggacactgtaagattcgttcctaggatattggactgaaaatcctgtgctttcagtcattgcagactttcagttttatctcttgccaaaatcatatctcactttaatttgcattgtcattactatatttaattctattttatgtgtaatttttcatatgtatatatatttcagttctgaatttcttgtttgtgtattttatctcttttcttatttattgtatctggatggtttgtcttttcctgattgatttgtaaaaactccttgtatatcatggatattgtttcgattgacatatatattgcaaatatttttcctaggttgtggtttgcattttgtctttgtttttatcttgtggagatgttttttatttttatgcactcatcattcaactgaggttaagattagctttatttttaaaaaataccattcactaattatccaaaatccatcaatttccatttaattgatttaatgatatctttatactagtttatattgctatagatgcttaggtctaatactagattcactactttgtgctgttcatttgtctattttagtttctcagccttggcactattgacagttttgggctagttattcattggcaggtgggagtgggcggctgtcctgcacattattgtaggatgcttagcagcatccctggcctccatcctctagatgtcagtaacacacaactgagcatccctcaactgtaacaaaaaaatacctccagccattgccaaacgtctttgaggagcaaaattgtccgcagttgtgaaccctggtctatgtctatccctctacctcattattttaataataactgtggcttccagcatactctggtattaggtagggcaagttacccccttttatcagaatttccacattcagaattccaaaatttagaatcacccagtgaattaagaaaaaaaatcctgatgtaaattatgtatcaataaggttgttatatttttaaaatcctgtcaacattttattgagtttgcatttaattcaaatataatttggtaggaactgacaccttttatgatacgcagccatcctcttcaagacatatcaccactgtgtcaggtgcttgtataatactttagtggagttctatggctttttttttgtaaaggtagagcggcagtctgtagccattaagaccacaacctttggtgcaaatcctaactctcttgtgttctggaaatgattttggcgagctggtgatgctttttgaagctcagttttctcagttacaaaatgattgtaataatgttaatgccaaccccatagtttgttttaaggattaagtgataaatgtaaaaaaaaaaaaccccatttcaacaggtgcttgttattagctaccattgcgattcctagatattttgtgtcttgtttttgtgagtagaacttcttctttcatgatgcgaattgtttctgtagcatgaagtttgttgactcttgcatataaattttacaactcaccaccttactgaactctcttatggttttcaatggttttttttttcaatatagtgatagcatctggaaataagggaatattgcctccttttttccacctggttttaactgcttgttattgaattgatgcgttatttagcactttcagaacaatttaaattataataaatgacaagcatccttgcttcatctggtgtaaatgaaaatgcttctagcctgtcatcattaaacattggttcctgagaagtattatcattctgttgaagtagttttgtattcttcctttcaaaatttttgttcgttcatttttttaatcaagaataaatattgacagagtagaatagtggttgccattctactatggcaaatgtggagttgctcatcagtgggcatgaagtttcagttacgcaagagagagtaatgctagagagctgctgtacaacaccgtgcctgtggataatgatactgtatcacacacttaaacatctgtgaagaggaagatctcatgttaagtgttcttgacacaatacaataattaaaaaaagtaatagacaaggaaaccaatgaaacaaaatagacacagacccacacaaatataggaatgatgcattattgaactggcagatgcagatgagtggggacagattgggcagttcaacaaatagtgcatggacagctgattagacatatgaagtttgaccccttacaccatacgatacctaaagaaattaactgtaggtggattcgagactcaaatataaaaggaagaactataaaacaattggaagacagtatcaaatatctttatgttttctgaattgagaaggattgttttaaggtattaaaaaatatagaccataaagcagtggtccccaacctttctggcaccagggaccggttttgtggaagataatttttccatggaccagggcgggaggatggtttctggatgatacaagcgcagcacatttattgtgcactttatttctattattattatattgtaatatgtgatgaaataattacacaactcaccataatgtagaatcagtgggagccctgaccttgttttcctacaactagatggttccatctggggatgatgggagacagatcatcagtcattagattctcataaggagcatgcaacctagatccctctcatgcacagttcacagtagggtttgtgctcctatgagattaatgctgccactgatcagacggaggcagagctcaggcagtactgtgagcaatgaggaatggctataaatacagatgaagcttcacccatttgcccaccactcacctcctgctgtgaggcctgattccttacagactatggaccagtaccaatctgtggccctgggggttggggacccctgccataaagggaaacataatatattcaattacagtagtattaagaacttctgttcatgaaaagaaaacataaagaaagtgaaaatccaatcctttaactgggagaatatatttcaaaacatataactggaaaattatttatatccagaatatataagtgatgcttacaaattaataaaaaggagaaaaccaacccaataaaaaatagtcaaaaggcactttattgaggaataaatccaaataacccaaaaagaagttctagctcattggcaatcagggaaactaattgaaatgaccagactgttttactggcaacagattaccaaaacttttaaaagcctgataatatcaagttattgtgaggatgtagaacaactgaaacagttttacagctctcatgggaatgtaaattggaacaacctctttggaaataatttgacactatccagtaaagactaaggccaacctatgaagaccctacatatcaagttcgctcctagatatgtaacctgaaaaaatcatatacaattgcacagggtcatgtataagaatgttcacagcaacgagttttgtgccaaaactaggaacactacaaatgtccacatatgcccagataattaattgtgatgtaatcatacaacagaatactatacagtggtgaacactggatccaagctacacacaacatggatgagttttggaaactgttgaatgaaaaagctgagtcacagaagaatgcatgtagtttgctccatttatagaaagtcagaaatatgcaaaaccaaacagtatgtttttagagatacaaacatattgtaaaacacacaaagtatgaagacagcaggggagagataaacgtatttagatttgtgaccacctgtgatgggggagggaagtgggtagaatagaggagggtcactcaggaggtttgtcctgatccttcaactgggtggtagatttgtgagtgtttgttcacacatgcattcaacaaatgtttgttcagagcctcccccctgtatcaggagagagagcagctgttctgcccaccagagctgatttctgatgctgagagataattgattaataaataatatatattctatagtgataaatgctaaggatttttttaaatgaagaatgaagaaggagaggaagtattggctgggatgggtgctgaaattttatatttggtggcaggggaagggctcactgcagaggtagcaggcatttgggagaatccctggaggaagtgaggctcagccctgtggctgtgtggggaagagagctgcgggctgaggaagggccagagcaaaggccttgagtgtgagggccaggggagggggcagcggtcagctctgctgtaaggacaggatggaggcaggtgactggagcccagctggagaagggtaaagagaggccaggtctgaggtggtgggttggagagtagatcatgatgaagactttggcttttcttctaaggaatatgtgacactataaggaggttttcagcaaaagagcaacagccactgcaacatgattctttctaccctagacatatcttatcaggatttcctatggtctgaatgttcgtgtcccagcaaaattcctatattaaaatcctaacacccaaggcaatggtattaggactgaaggcctttgggaggtcattaggtcatgggggcagaggcctcatcaatgggattagtgcccttataaatgaggcctgggagagacccctcactcttctgctctttaaggatgcagcaagaagacgtcatctatgaaccaaaaaaggggccctcaccagactcggaatctgctggcaccttgatcttggacttcccagcctccagaactgtgagaaatcaatttctgttgtttgaaatccacccagtttatgatattttgttatagcagcctgattggactaagtattcttttctgaaaattcaatattaatttgttataaaggtattcaaagacaaaagtgggtttttctcccacctctatctgcccactttattcccatgggttaatagaagaggaagcaggcgagcttacaattcaagtgtttcaattagtaaataagcttagaactcaagtataaacagctaagcctgcagtaattaggcattcaatgttgtatttcctaaatagcagccaggagctgctgtgcagatctagtctctggctgtgaccatagggttaacttgacactggtatgaacacatgccttgaagaattaggactctggttctcagaagtttctgttctccaatgttttagcccagttttgagataatgagagctcattaaagtcctagtgtaagattttacgaacagctgatgtgaccaggcctactagacaaaataatgtattcttctatatccataactaatctaatttttacaagaactggtccttttctttgtgttgtgtcattacaagaacatcactcgagcctcttggtcagtcattacacacaaaggtctctgcctccttattggtcctgctttctattttctgtacctgccattttacttgggcactgaatatctctttttagggacacacaggcaagccacaatggctctaactatttcttcttaacataccacaaggccctgcttctggcctcaagaacttaggagctgatggacaaggcagacgctgtacacacagtctccaattctcttctccagaagatcttttctgactccttttttcctagatggaattttccaagttgaatctcagtttactttccttctcatcatttcattgggcagcctgtaacttatttttcctttattatttgaccacggctccttctgttagctcacttttttccctacattagtgctgagaggtaaatgcgctggttatatgttattctaagctaaaataacacccgtttttctagaatgactgaatgatcttgctgggttagcagtgagtgaagaactattgctaattttctgtttttgaccttgctatgagttagacaagctgttcatagaaaaagtatgggcaggtaatttcttcatatttattttccaggcaaccctaatgggctttgtggtcacaaaaccctttcagccacaaggatgtatatgctggaaattgtggaataaaaaaacaactacactgaaaaagtgactcatttaagcactgattacccagttttaaaaataaattttatgtgtgcatttatgacctttcctcaattgttattgatgtaagcttttcagtggtttaaattggaaatatatcctggaaacctctcttttcttgatctttttctatggaattataggaaaaagcaaacatttacctataaaagggcatttatactctggcatgatatctgaaacctcctggagctacttggtgaggtgaaaaatgtgccgtacttaattaggtaatggcaaatgttttttacatataaaatttatttcatatctatttatctatattcaaattaaactgtagttgtcccttgatagcctcagggattggttccaggctccccccacccaggatatcaaaatcctcagatactcaagtcccttatataaaatgttgtggtatttgcatacaacctacatatatgctccagcatactttaaatcatctcaagattactcaaaatacttaacataaggtcaatgctatgtaagtagttgctatgttttattgcttttaggtatattatttttattgttgtattgtcacttttattttttttttctgcaaatattttcgatctgcagttggttgaatctacggatgtggcactgaccaacatgaagggccgactgtattaccatggcactgaattttctgagttaaagctacttaaaaatatcaccgttaggcctggcgcggtggctcatgcctgtaatcccaacactttgggaggccgaggcggatggatcacgaggtcaggagatcgagaccttcctggctaacacggtgaaaccccatctctactaaatatacaaaaaattagccgggcgtgatggcgggtgcctgtagtcccagctactcgggaggctgaggcaggagaatggtgtgaacccgcgcggcggagattgcagtgagctgcgatcgcgccgctgcactccagcctgggcgacagagcaagactccgtctcaaaaaaaaaaaaaaaaaaaaaaaaaaaagaaatgataacaaagaatttagaatattgcagaaactcagttgataatgcagcagcagagtttgagaggtcttgctacaatttggaaaaagttctactgtgagtaaaatgctatcaaacatcattgtatgctctagagaaacactttgtgaaaggaagagtcaattgatgcagcaaacttccctgttgtcttattttaagatattagccacagcctcccacctttgccaaccactaccctgatcagttggcgaccaacactggggcaagacctccagcagcaaaaagattatgactcactgaaggctcagatgatcattagcactttttagcaacaaggtatttttaaattacagtatgcacattggttttttagacataatactgttgcacccttacagtgtagcacacacataacttttatacacactgggaggcaaaaaaatactttggactccttttattgctgtggtcccagtgtctccgaggtatgcctgtacttatgtctgtgttgaaagagatgttatataaaaatctttgtggccagactaagtggttcatgcctgtaatctcagcactgaggcgggaggagtttgaggccaggagtttgagaccagcttgggcaacatagcaagaccctatctctaaaaaaaaaaaaaaaaaaaaattattagccaggcatggtggtgtgtgcctgctacttgggaggctgaggtgggaggactgcctgagcccaagagtttgaggttgcggtgagctatgatcatgccactgtactccagcctgggtgacaaagtgagaccctgtctctaaaattataaataaataaaaacttttaaaagcttttgtaaagtgccaagaaaatatgatttcaaattatgtaacggataaaactgaatatactgagtattttcctttgatatctattttcatagagtagttttagaaactcgaaagaactcatattgttttgctcataagtagcacttgcatccaggggaccctcaaactcaagccagagatggaaaagctcagacatgcatgaaaaggaaaaacttctggtcacgacgggaaccttaagtgctcaaggtaaagcctaaaccattaatgaattgactgaattaatggcaatggccatctatcttgaatggtaaaaatgagtctgaaagtatggctgatctgaaaagtggcaggaaaaagacagcttacttccttagaaaagagcattcctgccacccatacagaagtgaaattgttgaagcactggtttgaatgattgtttgtggggtcctgggagaaaagccagaggggaagaaatacctgctatgaacttcattttaactcatcatggatcatttgacaaagtcacattctagaaaactgttatccttgaaattcattttcggaggttttccaaagacccccgagtgggaaagatattaacacctgcttacctaatgataacaaaaacaactttccaggaaaactactaattagtcttatattttatgcctgtatattgtatctaatcaaaacaagctaaacatgcaactttaaaacatttatgacactgcaatcttatcttgatatatgcgcaccagaaattatggccccattctcaccaaaagatgtgttcaaaaatgttatagtggctttattttaatagcccaaagtcagaaacaacccatacctattagtaataggtggctaaataaattgcggtatattcatgcaatgaaatactacatagcattgaaaagaagtatctaattaatatgcacaacagcaggaatgattttcatagacatgatatcgagtgaaaactgtcagacccaagagtacaaatcatatgatctttagaatcagtaaactcaagtattgtgttctataatttaattttaattgatttattgtgttgatattattattttttagttgatattattcttgttctcccatttaacaaatatattccattattagttgctttttttcctatgaaatagggattttaatagcacctgcctcattgggttgttttttaaaatcaactttgttataaactttattatttaaaataaatggcacctattcaaagtgtccaatctgaagaagttcaaaaacgataaaagtaatagtcaaaggtgatgtaggtcagaatagtgactcctgggagtggttactgaatgggaggggtcctaaggaagtcttctcattgttagaatcttctatatctttatctgagtgatagttacatgggtgtttacatgtatagaaattaatcaaaggatgcatttaatatttgggtactttactgtacttagcccttaattttaaaatatgttaattttttaaaaatctagatggctttagataatgagattttatatttagaaatctttagaatcagtaaacttgagtgtttatgttatataatttaattgtaattgatttattatgttgatattatttttaagttgatatcattcttgttctcccatttaataaatatatcccattattatttgctttttttctatcaaatagggatttaaatagcacctgcctcatggggttatttttaaaaaccaactttgctataaactttatttaaaataaatggcacccatttaaaatggccaatctgatgagttcgcacagtgtgttagcccgtgaaaccattaccatgatcaaggtagactcccgggagtctcctcttgcccctttgcagtccattttttcctccacctggttccaggcaaccacaaattttctttttgtgcaaaaagattcgtttccattgtctaggattgtagataaatcgaattgcggtgtgtattcttatgtgtctggctcctttcacccagcatcatgctttcaagatttgtccatgttgttgcatttcacaatgggccacgcctttatattgtggagtgttattccattgtatggatatgccacatttgttcttctgctaacctgttgatggacatttggagaagccagggacatcatgggagaacagaagtgtgtggctgtaggaacacagttccacataacagtgaagaaaatggccatcctacctgcagtattacccaaaagtcaggtggtatgggacttttcctaggacttgagaatcagaggtaaaattatttattgtagatggtagataggtggataggtagagatagaggatgctattacattagagaatagtggatgcttagggcacctggctctgcccccacagagtaactggtgatcttgtcccgggcaaattatttcccctccttgagcctcagtttctccatctataaaactgagaatgtttaggattatttccaagactcttgcccttaaaaatataataatatttaaacaggtaagagtgtttgtaagttatgttattattcttttaaaagtttccattcatcattaacactgtacatttctattttttattttgttgacattgtcttctagtcatagttctctgccttataaagctctaatcgaatatctgcatgcttttctgtgaaataactttccgccaatgtaccataatggtatagattcaaaagcctttttgattaaagagaatattgatcttttcatcttaaaaaaaatttcacatcccttcaatgtatttagttgaggggccctctagtggaagaaggtggacatagcatgacaacagtggctgcttacacatttaatagccagtgatacgttttattcatttaaaaaaatcccgtgcctatattacagtaaaattctcaatactcaagttttcactcaggttgaacttctagtttggattccgtattaaaatgtatcagagactacatatataggaatatgacatttaattttttatcccgactattggttgttactgttagattagctttgtgggcaagaatgtaaaaaatcgatgaaattttatcttatcctcaaaaatgtattaaaggagaaaacacctgggtcctgaatgattttccagttttgtagatggttcctgcgtttttcaggtgaaaaagatgaacacgtgtgtgggctggagcaaagagtggtgggaggcaatgaggcatttcttgtgagtgtttgccaggtaactatatcgcagtcacatgggaacccacaggctctgctctctggggtgtttcctaaagcaatgctctaggtgtgatcaatgacacagtcactcccccaggagcactggctttacccattattcaacaggaaaatactgtgaatgacaactatttttagcttcagtcagaagccaatttgacctcatttactagtcttttctgtttttagaattgtaaatatagctaaggcaatttaattaaggaattaatctcatctttaaactgaatttcatgtgttatcagtgtcaattctaataaattggtataattcatccaaaatattaaataggttgtgttataggaaactcatggagtaaatgaaaagctaaacttcctataagaaacagatatgcttgaatttcatggggttaagtcattattctcattattgttttcttgaagaaattctttctaataacaatttcctgcaatgattcttattaaattaactccttcttcatagcagagggacaagataatgacccatgacaactaccttaagagttagatgtactgttattttctcatatgactatgaagaaaaatagctaatgaatatttggagtgcttttatatcttcccttaattggacccaaatcccattatttctctgtagatgttattgtcaggttatcttggcaaatcaaggagccagaggctcccattacatacactattttattactggctcattctggcacattctgaaaccgtttactctccaaaagtggacactggtcttctgagattcacatcgttggagaccactgggctcccactctcctggggaggctggaaggagagcagatgaggccatcgggcgactcacagcctgttcatctggcagcccagggcagaacaggcagcacatttaacttcaaatagttacatattcgcctgggagagtggttcccaagtgttttcagtacaggaacacaggatccagttttgaagggttgagagtgagcatgattgtgttttattgataccgatagcggggttggcagaacatgtttcacacataaatactatctgagactcaaaagtgatttggggacctcatctgcatccacgcccactcagctggccattcccagtgtcccagttccatgatgtaatttaagtggaattaaacttgtagagctagaaattgtatagttcttcacagccagcttccactgcaatcactcatagatgcagagctaccagctgaactccaggtagtgtcaattactcaagaaggaaggaaaggaggtcagacccttctggttcttattccctgaataatgacattaaaatggtgtgggctgcagaatccctgggccatctgtaggcaaccgagggctacctgttatctgctactctggctaacaatgtcaacttcgtagatacaaatcacatggatgcaactcccataatcccccagtggatgaggggcacttcgggaaccagtaaccctcttcctgttacttcctctctgtgcttatgtgagtctcttatctctctgtggctttcctaaaactcatcagttcttcaggaaatttggttgtcttcacatatcctagaagagatatttgatatttagaatttctagcaggttattagctgaagaggcgttctccatcacagctgagctgcttttatggaaccagcatctcccacctttggcagaatcttagtaattgcccaaggaggagataatcctcagagttaagcagccttagatatttgcagcagctgccccttcttggccacttagcaggggctgtgctaagcccttacatgcattattttatatattccccacaataactccgtgatgaagttaccattattgttcttactctacagagaaaaactgaggtttagagagataggagataattttgtggatttcttcagtaacgtaaatggcaatctaggtgatttcacttcagaaaatggcaggggagggccgggcgcgggggctcccgcctgtaatcccagcactttgggaggccgaggcgggcggatctcgaggtcaggaaatcgagaccgtggtgaaaccgtgtctctactaaaaatacaaaaaattagccaagcgcggtggcaggcacctgtagtcccagctactcgggaggctgaggcaggagaatggcgtgaacccggcaggcggagcttgcagtgagccgagatcgcgccactgcactccagcctgggtgacagagcgagactccgtctcaacaacaacaacaacaacaacaacaacaacaacaacaacaaaaatggcaggggagtctcatcccatacatagaccaaattataaagctggatttttgtgcacattcccgcccacagaggcaatgcccctaggcattcacatctatgctattaacatgacgagtgtgtctggctcgaagacccagctacccaatccaagtaaggacaccaaagaccatagcaatgccaaccaccagaaatcagagcctactgcatcttctataggtttggagaggccaaggaggactcaacacacaaggcactggttggatcaatgctttactcacaggaagaagagaccagcatcaagggtaccctgtggtgtgcacccacctcccatggccagaagtccttcccaatagccaacgcagggtgaagggctgaacacagatctcttgggctgctggagaacacccacattcccttgggtggtgtggtggtagaagatatactggtgaggctggccatgtagcacacacttgagcaatacaaggaagctcactctgtacccagaacaggggcgagttttctcctaattaggaaaaagcatcagagaacaagcaacagctcagcacttagcttccatatagaggaatgttccacgcccagggctctgatggagcaatcccagagaggggcaggcagttctcatgatggttgctttcccagcagtgtaaatatttctttagaattggatcttcccagcttgaagaagcctgaagatgccgctgatgctctatctgtagatgcaaactatgtagagggtggtaccataacccccaaatagaggagctcctggaccccagtttccaaggatgatcagctattattgctcagatggcaattttattaacttccccttctccttctttttttttttttgagatggagtcttgctctgtcgcccaggctggctggatcgcagtggcactgcgttggttcactgcaacctctacctccgaggtccaagcaattctcccttcctcagcttcctcagtagctgggattacagaagcctgccaccacgcccagctaatttttgtatttttcagtagagacgaggtttcgccatgttggctacgctggtgttgaactcctgacctcaggtgatctgcctgcctcagcctcccaaagtgctgggattacaggcgtgagccactgcgcccggccccttttcaagtatattaggtttggggataagtcaaattggggccatccagatcagcatctctcaaacttcaatgtgctcacaaagtcctatggagatcctgttaaaatacagattcccattcagcaggaacaagtagcttttgcatttgtaactagctagctctcaggttctgccaaggttgctggtctgcagacctcactttgaatagcaagaatctatatttcttccaagtaaaggaaaagaaatatcatatgcaaaaagaattctctcttctattctgtaaatagagaatgagtctgggaccataaaaccattttgtgtgtagaaagattttttccaggaaaatattgttttgccaaacttgctaaatattatctagttcttattttatttaatgtataaggacttcaaacattgttccaaagactgccagtgttctgtgagtattctgccagggtgaatgaagaaaactgttggagaaagaatgtttattataaacatttcattgagctaatctagactatccattaatgagtaagactcatctaaatgaatcaatctttttctctaagtttgtttcacacttttatctatgacctatttgaaacagctcttgggaactacaaaatgagtcctaaggctgt

SEQ ID NO: 586 - DNA, 136090 bp, Homo sapiens
tgccaaaaaattccatggtttataataattctctccatacctattaccaaactagaaagttaaatatagatacaatatatatttctttttttaaaagcagaaatgcatgtatattactctgttctcacattgctagaaggaaataccccagattcattaatttataaagaaaataggttgaattgactcacagttctgcatgattgggaaggcctcaggtaacttacaatcatgcctcttcacagggtgggaggagagagaataagtgccagaaggggaaatgccagacacttgtaaaaccatcagatctcataagaactcactcacaaacagaacagcatgggggaaaccacatccatgactcaattacctcccacctcgtccctctcatgacacatgggcataatggagattaaaattcaagatgagatttgggcgaggacacagccacactatctcagtatgttatgtagtcccagctatttttaagactgacgtgggagaatcccttaagcccaggagtttgagtccagcttgggcaacatagcaagaccctgtctcagaaaagaaaaagaaagctagagagcagaacaccacatttagagtctaatttctctaaaagtgagataattcccaaaaccataaatgaaagcctgaaaacctgtgtacaactttctgtagattatttaccctaagggacaaaatgtaaaattgaagctctaccaaggaaaagagtcctttataaacaacaaggctttcatttgagaccacaagatactatctttgtatgactacgtcacaagaggatttactcttggagtaggaatgcacagacaataaggcagtcttcaaaggaactgaagtccagcttgcatcctctaattgcttgattgaattaagactatctgagattttttattctccaatcccaactcttgaggagaaacacaggaaattctctctttaaaaaaaaaatcccaaaaaattcttgaattgccacttttcatatgcaaaattgggcactcaaaaaaagtaacaaagtacagtagacaaggcatgattgaaagacaagtgcaataaaaaaaagatgatctagataatgaaatataagcatttttaataagtttagtatgaacaaatattaaaacaagataaacaataaaatgaacaaaataaactgaaaaactaaaatgtataataacaaattaaaaacataatggtgggatttaacagcaaattagagaaaaaattagagaattagtaaactgcaaaaaatattagaagaaaatatgcgatcaaagcagacagcaaaaaaagcaaatgcagaaaacagtataaaagagatataaaggacaaagtgtaaaactctgacatacttttaatttaattacaattccagaaaaaggagagaaagagaatcaggtaggcaaaatatttgaagagatattgctgaaaattctctaaaactgctgagcgatattaagctatgaatttataaggttttatgagtttcatgaagaatgaattttaaaaacaataatttgttttaaaaggataaacagaaaaggtacagcagaataaaagcaaaatacagacaaaaattttaagaacatactgcattcaagaaaataataataaggccatgtgtggtgcctcatgtctgtaatcacagcgctttgggaggccaagtcaggtggatcacttgaggccatgagtttgagaccagactagccaaatccagtctctaataaaaatacaaaattagccagttgtggtgccaggcacctgttatccaagctactagggaggctgaggcagaagaattgcttgaacctgggatgcagaggttgcagtgagttgagatggtgccactgcactccatattaggcaacagagcaagattctgtagaaggaaagaaggaaggaatgaaggaacgaaggaaaggagaggaaagaaggaaaggaaaggaaagagagaaaaggaagaaataaagaaggatagaaggaaagaaagaaagaaaagaaagaaataaaagaaagaagagaagaaagaaagagaaaagaaagaagaaaataataagactgacaaacttcttcttaaaagatgcagtgaaaaccaaaaggaaaaggaaatacctcttcacagtgataaatgaataaaaatgtcaacatagaatccatttaaaatctcacagaagtgaacgtaaaatacagagatttctgactaatttaaaaaatatttagagattctagaatcagccacaaattatggaataagagctctgaagaaggatctttggaaggaaggaaaaagctctgaaatggaaaaaaggaaatgcaggaaagaaggaagacaaattgaaagaagaaatatagcaataaataacatgaatgttaatcatatgtaaaattaataagtatgaaaccaaaagaaaagtggtggatttgaattcaatacataattaactttatctttttaatgagcaaaattctcctatttaagaaatagaacacaacggtaagagccttataagagaaacatcttaaataacagtgtgaaaaggtgaaaataaaataatagaataaagtgcataaattctgaccaaaagaacactatttctatgctaatatcagacaaaactagacttcaaggcaagaaatatttccagaaataaatttttataatggcaaaagattagcaatatgaagataaaattataaataggtacgcacctgaaagcacaactttatacgttattttttaaaatagactgagctaaaaggataaataggcaaatcaacaataatacaggaagattttagcacaactctaagtgctagaatacacacaaaaaaatttatgaagatatttatgattcaaacaaaaccatttagaaaatttgacccactgacataagagatcatcacatacaacaccaggaaaatagacattcttttcaggagcatatgaaacattttccaaaatcaatcatatactggttcataaaacaactctctatgaatttcctataatcaccataataaaatatgtcactgaacatcaagaaaatcagctagaaaataaaaaactaaaattacccagaaattttctatctcaaaattaaacaaaccacttttaaataatccattagtaaaaataaatcacagaagttaggaagtattttgagcctaataataatgaaaatacaacatatcaaagcttgtaaaactcagctaaaatattacttgcattttctagaaaataataaaaactgaaaatcagtgcactaaatatctattcaagaaaacatttcacttagcataatgtcctctaggtacattcgtgttattgcacatgatataaaaacatcccactgtactccacaaagaaagaaaaaaagaaagaaagagagaaaaaaagaaagaaaaaaagaaagaaagagaaagaagaaaataataagactgacaaacttcttcttagaagaattacttcttaaacaattactgtttgtcaattaaaaacaaaataaaacaaagaggttattaagtcttccaaggtcattcatgtcaaaaatagcagaatgatcttttgaaggtttaatgatatttgattatgaaatattattgcattacatatacaaaaacagagggcaaaaatacaaattttcatttttgttggatgaagtaatactggtgatgtaaggtacagcataatgtctgttgtcaataataccatatattatgtgagtataagtgtgcatgtgtacattagatagatagatgattgatgatagatagatagatagatagatagatagatagatagatagatagatgtcacattgcctctattcattcatctattgatggatatgtaagttgtttccatatcttggtgattatgaataatgctgcagttcatatgggagtgcaggttatctcttcaagatactaacttcattttcttttgatacataccaagtagtgggatttctggatcagatggtagttttatcctccatagtgccttctataatggctgtatcaatttacattcccgccaactatgtaacaggcttccctgttctccatactgaagggtaaataccacatgattttaattatatgtggaatctaaaaaaagaagtcaaactgataagatcagagcgtataatggtgattgggatggaatgcggggagaagaaaagagatgttgttcaaagagtacaaagatgcactcatgcagaatgagtaagttctggagagctaagttacagcatagagagtatacttgataataccatattgtacacttgaagtgtgctgagaaaatgcatcttaaatattctcaccaaacacaaaagttaattatgtgaggtgatgaacaggttgattgtggtaatcatttcacaatgtatacatttattaaaatatcacactgtacatcttaaatatatgttatatattttttgtcacatacacctcaatacagaaaataaaaaacaaactatgttttaaagattacaacaacaaaagaagtaactaatttgcatagaatggcaaaaacagacaaaagtagacaactgttgcactgtccctggaacgtagtctggaagcactggagtgaaggagggcagtaatttgagcagtcagtctggttttccactgtatgtggaaggaataataaccatacttatggatctacactgaaaatggacactggctaacaggtttgataagctaatgaggaaattggaaatttaaaaatggaaaaatgatgacaaagtagttggaagagcagtatgttctaatgatacctgaacctaaacgttaacctggatgcaaagaggggctgctctgggaaagggcatgcgacctttattgaggtggctttctgcaacttctaaagatactgaagtggatatcatctgaatgctgtctactaacagcacacccccaacagctggaaaaataaattcttctttcctaaatgaagggcaaggcagaacctcctcatgtatactgtaatatatcccttatgccatttgaatttatatattcttatacatgatcagaacagctcttctaggattctcttacttgaggggaattagaagagaaaggcttgaggacaaactatgtatcttgccactgaagctgatctgagttgcaacacaagggaataatgtagcctatagtaatccttttattttttcacaccttacttgttgcaaggttttgtgcttttccctcttccatcatcaaaagtagattttaacagcataattattttggcaatttaaatgtttacttgtaaaaaacaggatatgtaaactatcctctatagcttaagtaattaaaagtatactttaaaaactgaaagatagcattactatgacttcaatgtaaactactgttaacatttttctagaaaaacaatgatttaatgtagtttcctgagaacgtgacatttttcaaaagataaaattccataataacagaaaaccttcataatacatttcacagtcacacttttataaatctatttaaatgacagtagccaaggtactaacctgagcatatttatttactagtacatttactgggataatttttagatttataagtaaaaacccatattatgcttccagaacataacaggcatttgttcctttaccctcctacaaacttgacatgatctgaagttttaaactttcccgtcaaatatatctgaaattagtagtacacctttactaatatatcgtataaaatataacatcccacaaactaagattataattataaatatattggtttattatacatgtaatatggaacatgttttttcttatttggaaaatagaaaaagaaaaaattaggctatatattaaaaccaaagatacattccatatgtggaacaattttcatgtttgctagcttaactgtctaaattagaattctttaaaaactcatatggatttaagacattagctacatatcaacatatcacaggaattttcaatgaatatctcctgtcagtggtttcaaatactcacatcattttccagaaaagcaatgcttctttcacagagcattattgtagatacctcatgcatctatgtgtgatcataaaacacacgaaatggatggctgatccagggatatagaattcgttcctagtggctacagcttccactcttccacacaggcttttcattatcttggtcattagagaattacggcactatccaaagcagatgacaaaaatataaagatgcttaaacttaataatgtagaaaggtagttgaatattctcacatgctggggaattttttcatagaaaaagaaagatactatctttgcatgactatgtaaatattgacctaattggtggaaatgcacctgcacaagccccttattttatgaccaagaatacaaaatgtaccaacactaaaatttgttagtgaaagtttcctcgattatggtgaagcaaccataagtactttactgtgactgaggatttataagattcatgtgcccagctattaaggtttatacctaacaaggaaaatgctgaaatttaacttcatggaaaaaccaatgacagagctttctcacagaaagaagccaaactcttcagtctctcagtcattcaaatgtcattcaaatagcatacccctaagtccacttttttcctaattaaaagcatgtccctatatctctccccaatcccagtaaattgagaactttcacaatttttacaagaaatggaggatatggcaagaaaacatcacacatagaggactagataccaactgaagacatactctaccttaggcagaaatttatttcagatatctcttgggttattatatcaagaaaataattatcccatttatgtgtagacacaatctatgagttcgacatcatcactattttaaatgaaagaggcagtaaggtcattatagtttagttaatttgaatatttggaataaattcaaataacataatcttgttgaactctttttttccccttagaaaacctctagaggaaaaaaagacttgggtctccccaagaaagactagctaaatgccaggtaatgtgaaaaacctataatgtgaaaaatatattctaaagaaaattggacaataaattatgagcttcacattctgaaatactgaggtaagacaaatgatatttaagccagaatgaatgggaagctgttgtgggaagtcagggacactgaacagagtcaccagctggaatcacggcagaggaacataaattgtgaagttttcatggacatttgagttcccaaataatactcttataatttattatgtctgtctttactttaatctcttaatcttgttatcttcataagctgagaatgtacattacctcaggaccactattgtacaaattgattgtaaaacatgggtgtttgaacaatatgaaatcagtgcaccttgaaaatgaacagaataacagcaatttttgggaacaagggaagacaaccataaggtctgactgcctgcagggtcaggcacaatagagccatatttttcttcttgcagagagcctataaacagacataaaagtaggagagatatcactgaattcttttcccagcaaggaatactaataattcataccctaaggaaggaatgcattcctggggggagatctataaactgtcgctctgggagtgtctgtcttatgcagttgagataaggactgaaatatgccctggtctcctgcactaccctcaggcttactaggattggaaaattccagcctggtaaattttggtcagacgggttatctgctcttgaaccctgttttctgttgcttaaggtgtttatcaagacaatatgtgcacagccgaacatagacccacatcagtaattctaatttggtcctttgccttgtgatatttccttcaccctttgccttgtgatctttattgccctttaaagcatgtgatctttgtgacctactccttgtttgtacaccccaatcccctcttaaagtccttaataaaaaccttccggttttgtggctcaggcggacatcacggacctacagatatgtgatatcacccctggtggcccagccctaaaatttctctctttgtactctttttctttatttttcagaccagccaacacttagggaaaatagaaataacctgtgttgaaatattgggggcaggttcccctgacaggaagccccaggttctcttctctgagcatattcctagtgaggagggccttacccttactgttagaaggtccattcccaaaaagccttgaggctaagaagcagagagcctaagaaccgaagctgaccttctgattcttggcaaacagatcatcatagttctgcagttttaggttagagtacaggcttttgatcaaggcctgaatctatgttacatatgaccatagtgatctgaagtacattaattcaatcctttaattttattccaatatcaattcagtaactgtttctacaataaagaaatttgtattttcccacaacagagcagtgcctaagctcttcaattgttatttccatgacttagcttacaattggctctgttgaacatcttcatctcatcatatgtttaaatattggatattctgtgtcataagagccttagataagagtcccataaatacttatctgaacgagctaaggagcttatcatgtaacaggctccactaaatgttggtcattttcaacttacctaataaactgattgaatacatccatcccaaatgccatatatatgaattctaaaatatgaagactgtgtctataagtgctgtgctgtcttattggtaagtggtaaaagatgtacaaacatatctttaattctgaagaactatcagatatgatcaaagatatcatgatttaattatgactccaagatggtgaactaatatgaaaataagccataattctctgtgtcccttctatctgaattcaaataaccactaatgctttccacttttcagaatgacacaaaagtgtttgttagatcggatgatgcctacaatagcacagaatctgaatttatttgctccaataataaaaagtagacaaaaaatattaactaatgtagaagttgtcaaaaatttcccattgtccatacaaattttctgcaatccatacctattaccaagctagaaagttaaacataggtacagtatacactcattattttttaaaaaaagaaatgcatgtatattagtgcattctcacattcctataaggaaatacccaattctgggtaatttataaagaaaagaggtttaattgtctcacagttctgcatgattgggaaggcctcaggaaattacaatcatacctcttcacagggtggcaggagagagaatgagtgacagcagcagaaattccagacacttataaaaccatcagaagtcatgagaattcactcatgatcaagagaagagcatgggggaaaccacccccatgattcatttacctcctacctggtccctttcacaacacatgaggataatggagattaaaattcaagatgagatttgggtggggacacagccaaactatattagcatgttatgtagtccaaggtattgttaagactgaggatttcagggttcatggtggatgggagcatggactagattgcagctctggaatatatgtattaacagcatatccttcagtgcacgtagcatttgcttatccatgcaatgtctgcatattttcatgctcctgtgtggtaacctcaccatttggttaccataaaaaagaggcagaaaaaccactaatgaatggatatccaagaaattcggcaagagagaatgctattatggaaggtcataaaagtattctgagggaagttataagtgggcataggttccaacaaagaacccaggttttgactcataaaacaaagaaaatgcctctggcctaggattttcagatggtggccactttaatatatgcatgaataacatataatgatgagcagaataatgacatagcccagtaagccaaccaaaatgtggtgaagtataaagttctgtaaaactatgagcagtatttgctagggtcaaatattacaacacagtttcttggctatttcataggaccattagccatagatcctagtggtttcaactagacttatccttaaatggatgtttttctattttgtaattcacttagcctatgccccaagccacaagtgacaacactgtcaagctacagaaactctacataataccaatttgcccaacctagtacatctcatttatccaagatggagatttcctcatggcccatggacataaatgggctaaaaagtatgtcacatggacatattataccccttacaactcacataatagtgatgtaataaaagctaaaattgggtttaaaagagtaataagttattgaaaaaaatcatagcagatgggaaaggagcacaaagatggataataattcctagaaaggatatgattattattttcccatcagattatattgaatcttgagaataaaactgttaattgtttctctcatatatgacatgaagtcatttactgccgggaaatgatactagcctccttttcacatgagtgggagaacttaaattaaggtatttaacgctctgcttcagaattatattatttggaaaaaaattcccaatgcaataaatggctctgttgataaaactgaataaaaacaaatcataaatatgaataaatgaagatgataaaagataaagaaggaaatggagtagtccaaatgatatttaaaaaatgacatggtttgaatctgtgtccctacccaaatctcacgtagaaatgtaacccccaatgctggatgtagggccttgtgggaggtgactggattatggaggaagtttctcatgatttaacatcatccagttttgatactgtcatcacaatagcgggttctcataggatctggttttttagaagtgtgtggcaactccacttcttgctcctgctcctgccatgtaagatgtacctgctcccactttgccttccactatgattgtaaatttactgaggcctcctcagaagctgaggagatgccagcatcatgctttcagttacagcctgtagaaaaatgagctgattaaacttattttttaataaattacaaagtctctctgatatttctttatagcaatgcaagaatggactaatacaaaaaattagtaccaaagactgggaaatttctataaagataccagaaaatgtggaagcagctttggaattcggtaacaggcagagtctgaaagagtgtagaggacttagaagaagacagaaagatgagagagagtttggaacttcctagaaaagtttgaatggctgtgaccaaaattttgatagtgaagtgaatggtaaactctagactgaggaggtctcagaaagaaacaaaaaactaaatgggaactggatggaataagggtcatttttgccaagcttcagcaaagtctggctgcattgtgtcccttttctatggatccatcaaactttgaacttgagagtgatgatttagggtatctggcagaagaaatttctaaacagcacagcattcaagatttatcctggctgcttctaataacctaagctcatacaaatgagcaaagaaataacatgaaactggaacttatattcaagtggaaagcagagtgcaaaaggttgaaaatttgccacctggtcatttggttgaaaagaaaagcccattttctgggaagaaattcaagcaggctgcagaaatttgtataagtggaaccatgtgctaaccaacaaggcaatggggaaaagccctcaaaggcatttcagagatcttttcagcagcccctcccatcacaggccagaagacctaggagaagtgaacggttttctgggccagtcccaggaccctgttgccctcagcagccttgtgacactgttgtgtgtatcccagccatttcaggtccagctgtgactaaaaagggccaaagtacagttcagatgatgaaagctgtgaattttgaaggctttcatgtggtgttaagcctgcaggtgaacaaattgcaagagaggaggcttgggagcctccaaccaggattcagaggaggtatcaaaaagtctggaacttcagaccaaagcctgctgcatgggtggagaatcacagacaatctgtactaggacagtgcagagggaaaatgtgtggttggagcccacacacggagtacccacgggggcactgactagtggagctgtgagaagaggactaccatcctctagaccccaaaatggtagatccaccagaagcttgcaccctgcacctagaaaagccatgggccccctcaagagcaacaaaagacattaagagcaactgtgctgcccaaaccctataaagccacatgagtggaactacacaaggccttagaagactacccattgtaccagtatgccctggatgtgaggcatggagtcaaaggtaattgttttgtaacttcaagatttagtgaccactctgccagattacagatttccatggggcctgtaacccctttctttgtgctgatttctccattttggaatgaaagaatttacccaattcctatatcttctttgtatcttggaaataactaggttgcttttgattttacatgcttaggtgaaagggactaaccttgtctcagacgagactggactgtgcacttttcagtcaatgctggaatgggttaacactttgggggactgttgggaaggaatgattgtattttgaaagttgaggaaaagatgagattttagggaggtgaggagaagaatgatatggttttgatctctgtccctacccattaactggcctgacatctctactttctaccactgggatctctgaccaccatgtaaaacacctgactatacttttggttcttctggttcttcacctaaatggataggaagaaggacccagggatctttacagtcatctcttccaatatattataaatgtgaattaagttattctgcatcctacagactaccctgttagctgaataaggcagtgacttcagtcctatactccaaagcagaagaaataccaagccaacctgcctgaatttctggcacacaaaattttgaaataaaataaaatggtggtggttttaactcacaaaaactgtgaagccttgcaccatgcctgaagggaggaccagaaaaaaaagtggtacctcaaagtgtggtgattccataacaacaattcagtgtgtattgcattggctatagtgccaaaaaatagaagcctccagaatgttgtaagtggaggctgtaaagacagaagtaaatgttcttgaggaaagggaagagacttagtcactatccagtgctggaaacctttagtaattctgtcacctgtagtaaagtagaaaataaaaattgtacctaagagaatagggggttttggctaaaatttccaagtagaatatgataagttaccactgtttcttatagcaatgtatcttaccataaggcattagattttgttataaaaaataacaaaagattaactgttacactttcaaacagaatttacaagaaacatgaaagagccagaatttgccggtttcagaaacagaactagtttccctttccagtctctgcaaagagctaagtactctaaaggtaagaaaggtcatcaaaataaatgtcatttcaaagttgtggatgttaagaccctctcgtatatactttaaactagacaaacataattctaacattcttaagagtattagctcactgcacatagactttcagcccaagtctgagaagggccagtttcaaagatatttgtgagtatgctgcttgtgagtgtactaaagcaagcaccataggcttcacttgtgaacaggaggatctattttaattgcctggtcctctctttctccattatgtgctgggcatgtggaagaaatacactgtctcaatggatttgtaaatagagaaaaaccataatttaaaaagtgcacaatagacactgcacccaaggatcccatccacattcggtctggatatagaggttgagatcttgaatatcaaacagatgccatgatgggatgacatcttatttgagcggggagcttcaaaatcctgccttcccaaactaggaaatcttaattgaccttagaagtctaacaatctcacaggacagacgttgtctccatacacttctactaaaagaagagaaacactcattctaactatagttaagtttttaatgccagagtttttttacattggattttacagcaattctcatctctaaatttctcagtgtgtatattaatggattcaacatgtgtatgataactgtataaaacacagtcatgaatttatcaataggaaagttcgaaacaggtctaacgaaaaggaaaatacagggaacaagaaacaggacagtgactgttatgtaggagatgcaggcagacagggctttaagcctcccttcctgactataagttttaaagttgtttaggatgactccataggagattagtagaagggtgaagacgaccatacagattgctagaccattggcaacaacagtgagacctataaagtaggtatcagtgcaaaccagttccaataatgggtacatgtcacagacaaagtggtcagtgacatttggccacagaacgagagagtgtacacaacaacaatttgaaacacacaactcacaaaacctccagtcacagccaccaccaacagaaggatacaaacctgttgattcatgatggtcaaatagtgcagtggcttagagatggccacatagaaatcgtaggacatccccacaagtaggaagacctcagcaccaccaaataagtggtctataaatagctgccccatgcatgctgtgaagaaaatagtctttttatcatggagtaagcctataatcaatttgggagaaatggtattggaatatgcagcatatataaataacaggctgtgaggaagaagtacattggggagccaaaggaagggctggaaataatagccaccacagcaagcaagtttcccgccatactcacaacgtatgtgagtaaaaccatgacaaataatgcattttgcacatcaggacactgagtgttgcccaagaggacaaattctgtaacattattactcagtcccctttactcttctctaaggcttctgtcacagttgagagctcaggagaacaggacctgtaatgaaatagtgaacaggaatatgaatacatccatgatgtcacagagcacctcttcatcattttatcttcagtacagatttacacacacaataaactttttgtaagtttctattgagtttctcatcttctcaaagattttagtttgagcctacaggtaacagcttgtgcctctaagtttttgtgaatattctgtacagaagaagagttaaaggcccactagccattcatatatttcataactcctatttaaaacatatttcttggcatggaagtcagctatgatgaataggaaacagattattggtctcaagaaagttactttctcatggcggtaacagactttaaataaataagttggcatagattcagtactgtgagtttgtagttttggtatctttatgatctgtgtagcatcaaaaataacatcttctgaaatagctcactcagtactgtggcaatccacagttactcatttggtccttcatgcctcaaaaaatattcggtctttttgaatatctcattaaatgtcaaaagactggacattgacttgtacaaatagtaaaatattatttatcacgttgttccctatggcaacgatttggtctgaccctctgttgccttataacaagatatatgtctctatatcttatccttacttatttcacaaattttttgtcacatttacatacaatatcctggttttcaacaactaattttgaactcaagtaaactaattgatgaatatcaccaactgccacattagctgtgagtaattttttctgaattcttcaagtgaactacatagtgagggaggagaaaatatacactgtacaaagaggaacagaatggtggtacatggtttatttataacactatttagatatcaggagtactcacaaatagaaccttagtgttaagattccaaaaaaaaaaaaaagcatactcgaagagaaattccaactgcactgtaaggtaacatgaatttgagtcattttctgaatgcatttacaagtctgtcttcgtttgctcacaggaaaacaacatgattaaattagatgaagtgaaaatcctttctagtcaaccatctacaaaactattagtgcacctctcccttactctgttctgcagacttttttatttttcatatatttataattaaatagcaatttccaagctcatgactgttacattaataacggtagtcattgtagatgtttcatgattacagtgagtaaataatgactacaagtttctctttcaatatgtgcctaattaagtttcaagacatcattggagagaaggcatagcatgtggtgaataatgtggacaccagagccacactgcctctgcttcaacccctgcttcaccacttactatgtgtctttgggccacttactaagcctctctgtgcctcactttgatttaaaacctcttagggttgtcttatcacaacaaagtaaagtgcctagaacactggctggcatctggtaaaggctcaataagtgatggctattactcatgttcctgaaagcttcactgtgaacattggatcagaacgaatcatctggatctttgctaatttgaaaagactaatagacatagtcctgggaaaagaaaaaaaatacacctataattcaggaatggcttttggggaagacaatatatgtcttagtaactacctgtttaattatgtatgagtacttattttatctgtgatggaatgtatcttgaaaagatcaggaagaattatagtgaaaaagttggacccctcatcagaggtagagcgaaatggtagaaaatggaagaaaaaggagtcaagtcaagaaacacagtaattacaataagttaatatacacaggtaataagaagattaagattaatgtgataattgacgcaattattctcctaaaaatcttcataaagatttttagtgaggaaatactggaagcacaacctcctgtttgtccctggggtgactcaagaggcttcttggggtagccaaacacagaccaaattctagtgaataaaaaaaagaaaaagaaagaaaactcagaagaaaaacagaacacactgatttctcaaagtctctaggtcagatagataaggacaaatttaaattacagagaacaatgggacaagtagaaatacaaacccaaacttcctgattactcactgatgaggaaaatggcaaaattactaaacctcaagtgtagacaagatgattccatttgcatagatctggcagtggaagaggatgtgtacagagagagtttgagctgtctctagaagccagagtgatgaacattccacatgtctaattcacattacctctttcagttgattccagagttctgtcactgttgaagctgtagactgatagagacatatctgctgaagaacaaaagggaataatatagcctatagccaattctgttatttttccacaccttacttcctgcaaggtttactgtcttttccctcttccatcttcaaaactagacttcaacaacaggataattctatttggcaatttaaatgtctacttgtaaaaacataaggtatgtaacctatcctctatagtttaagtaattaaatatggaatactttagaaactgaaagacagcattactaggctttcaatggaaaccgttaacatatttctagaaaaaatgatttaacagtgtttcctaagaacatgccagttttaaaagataaaattccataacaaaaaacttctataatattacatttcacagtcacagttatataaatctatttaaatgacagtagactaagtactttcctcagcatatttatctactagtatgattgctgggataatttttagattcataagtaaaaacccatattatgcttccagaacataacaggcattggttccttcacaatcaaacacgtttgacatgatctgcaattttaaactccataatcaaaaatatttgagtaattgttcacctttattaatacggtatataaaatattccataacctaagattatgattataaatttattggtttattatacatgtaatatggaacatgtttttcttcctatttggcagaatggaaaaagaaaaccaatttggctgtatattaaaaccaaatatacattatatattctgataaatttccatgtttgttggcttaattttcccaattagaatttatccaatgaagtcatgtggtatttatgacattacctgtacttcaacatatcacagaaatttgcaatgaatatctcttgtcaatggtttcaaatactcacattttggtccagaaaagcaatgtttctttcattgagggttactgtagatacctaatgcatctatgtgtgatcataaaacacatgagtataaatggctgatccatggatatagaattagttcctagtggctacagtttccacagttccacacaggcctctcattatctcagtctttagaggagtatagcactatccaaagcagatgaccaaaatattaaaatgcttaaacataatgtcaaattttattctacaaatgtagttgaatgctcttacctgctgaaaaatttcttcataaaaaacaaagatcctaaatttgcatgactatatacaaattgacatacttagtagaaattaacaaagatgagtccattattatttagtggcaaaagtatcaacactacaatttgttacttgaaagttttcttaattatggtgaagcaaccagaagcactttactatgattgaggatttgtgataacattcagggtccagctactaacctttgtacctatcaagaaaaatgctgagattcaacttcatggaaaaacaaatgacagagccttcccataggcagaagccaaacatttcaatctttcagtcattcaactagcatatccctaagatcacttctttcctaagtgaaaccatgtctcttcatctccccaatctcatcccaggaagttgagaactttcacacatttttacaagcaatggtgggtatgacaaaaaaaaaaaattacacctagaggactagataccaactgaagacatacgctatctggagcaaaaaaatcactttttcaatatcttcagggatattctagcaggtaaataattcatccatttatgtgtgtagacacagtctatgacttttacatcaacaatattttaaatggaagggactgtaaggtcattatagatttgttaattagaatatttggaaaatgtaaagcacccaattctgtcactgtttgtggcaccacttgtaacctgctacaatccctggtggactgaacaaagggggtgaaggcgggaataaaagcaaagagacaaagagtatatttggaagaaggggtcgggggcatcttgcctctagtgaaaaagggtcctgagctttacacaaccctccatatttattaggcaaaagagatagcgaggagggcgagtagttgtcagataactgtcagtccaccctttggttcacagcaggcttgcgaggctgtattccaggaacaattggtgctagatgtctcaggaaataacttcaaggagcccagtgccaggaggtgatggccctcagcaaaccttctggtggcaggcacagatgtgagtttgcccacatcctgcattcatggtaaacagtttgctgtttgatcatatagcctccagtggaatgctgagctggtcacaatgcctctgctggctctctacatctccccgtttctgtttatggattaattaaaagaatataaggccaggctgggcagatctcattttctgtttagtggtccatctgattttacagactatgaacagaagacagagacaaaacaacattattccaagaactacatataagatgttaatgtggtgccttaaataggtccaagggttgaggctctccaggccttgctggaattcggtccagtcttctaaggctgaaattcttgagtttccctatttaaatcaagaattttgttttgtaattcactgatatcaaagatgatattggatgtgaaagctcccttcaatgggctttcacacagtgccatggtgccatggatactcactttggttatattctaagttggttacacaaatgtgagtgtggttacaatggcgacagaattgctgctgcaactgcaggctttgtacttgttcctctaatcataggactgtggatttcaacattgcaacttcagtttgtaactcaggattaattttattctggccatgatacctgctggactaaacaaagacaaagaaaaaagaaaatatatttggaagaaggggtcagagggcaccttacctctagtaaacaagggccctgagctatacacagccctccgtatttaccaggcaaaagaaatagccaggaggggtgggtagttttcaggcaattgtcagtcatccatttggttcacaacaattggtgttaaatgtctcaggagataacttcaaggagccctgtgccaggaagtgatggccctcaacaaaccttttggcagcaggcacagtgtgagtttgctcacatcctgcattcatgataaacagtttgcattcatgataaacagatatattcatatagcccccagtggaatgctgagctggtcacaatccctttaccggctctctgcaggaacaaattcaaatgaagtaatctctctgaaaacctttttttctaagaaaatccctagaagaaaaagacttggctcttgctaaggaaaagtagctaaatgccaaataatttgaaaagcctgtaatatgacaagaaaaactcaaaagtaaattgaatagtaaattatgagttttacattatgaaatatttaggtgagacaagtaatatttcagccagaatgaaaggagatcgagccccaggctctcatctttaaaaatgttcccagtaaggagagcctcacccatcccgttaaaaagtctgtgcccaagaaaccctgaggctcagaggcagagagcctaagaacagaagttgacattctgattcttggaaagataggtaatcatagtgctgcagtttaattagagtacaggcttttgatcaagacctgaaactatgtcagataaaatcataatgatctgcactccattaattcaatcctttaattttattccaatattaattcaataacagtatctacaatacagaaatttgtatttgccaacaagtgagtagtgcttaagggcttccactgttatttccatgacttggcttaccattggctccatggaacaccttcatctcatcatatgttaattaaatattggtgtgatagaagccttagataaagagtcccataaatacccatctgagccagcaaagatgtttatcacataatgagctccactaaaagttggtcattttcaacttacttaatacatgttttaaattcatccaccccaaatataacatgtattattattgctaaaacttgaagagcatatctatcaacattgtgctctcttactagtaagtggtaaagcatgcacaaacatatgtttaattctggggaactatcagatatgatcaaagatactgtggtttaaattatgactccaagatgaagaactaatatatgaaaacaagacctaattctctatgtcccttccaacagaattcaaataactactaataccaacacccactgtggaaataaatccttcctcagccaagccttcatatgagatggtagacccaaccagcaccttgattacagttttgtgagagaccttgaagcacgggaacctgccaaaccacactgtttcctcacctacagaaattgagaatgagtacaaattgtttgaatcactaagttttgaaatattttgctatgaataaatatgtaactcataaatgtatctagaatatacttcaaatactgggaaacatgccaataaatatttagtgaacttatgaatcaaagaaaaagatataatgaagctaagcaaataaaactaagcaataacagaaacatatcaaaatgtgtgaggtttgatcaaaacagtacttaaagaaaaatgtatagctataaatgcttacatttaaaataaatgtttaaaagcagccattcaatccttcaccttaagaagctagaagaagagtaaataaaagccaaggtaagtaaaaaaaggacataaacataagatcaaaaaccaataaaatggaaaacataaaatagagaaaataaaaatagccaaaattcgtacttttataatcaaattgataaactgtcagcaaggggagatcaagagaaaacaaagagaaatccaaattaccaatatcagaaataataaaacaaataatcatcccatagttcctttaggcgttaaaaggttagaaaatgatagttatgaaacgcattatttctttttttttttaagtttcaaaacgtttatttatttattatactttaagttctgggatacatgtgcagaacgtgtaggtttattacataggtatacacatgccatggtggtttgctgcacccatcaccctgtcatctatattaggtatttctcctaatgttatccctcccctagcccccagcccccctgacaggaccctgtgtgtgatgttcccctccccaggtccatgtgttctcattgttcaactttcacctatgagtgagaacatgcggtgtttggttttctgttcttgtgttagtttgttgagaatgatggtttccaacttcacccatgtccctacaaaggacatgaactcatccctttaatggctgcatagtattccatggtgtatatttgccacattttctttatccaggctatcaccgataagcagtagggctggttccaagtctttgctattgtgaacagtgtcgcaataaacatacatgcgcatgtatctttatagaatgatttataatcctttgggtatatagccagtaatgggattgctgggtcaaatggtatttctggttctagatccctgaggaatcaccacactgtcctccgcaatggttgaacaaatttacactcccactgacagtgtaaaagtgttcctatttctccacatcttctccagcatctgttgtttcctgactttttaatgatgggcattctaactggtgtgagatagtatctcattgtggttttgatttgcatttctctaatgaacagcgattaggaggtttttttcatgtgtttgttggccacataaatgtcttcttttgagaagtgtctgttcatatatccttcacctactttttgatggggttgttttttattttattttattttattttatttattttattttattacactttaagtttttgggtacatgtgcacaatgtgcaggtttgttacatatgtatatatgagtcatgttggtgtgctgcacccattaactcatcatttagcattaggtatatctctaaatgctatccatcccccctccccccaccccacaacagtctccagagaccgatgttccccttcctgtgtccatgtgttctcattgttcaattcccacctatgagtgggaacatgtggtgtttgggtttttgcctttgggatagtttgctgagaatgatggtttccagtttcatccatgtccctacaaaggacatgaattcatcattttttatggctgcataggattccatcgtgtatatgtgccacattttcttaatccagtctattgttgttggacatttgggttggtttcaagtctttgctattgtgaatagtgccacaataaacatacgtgtgcatgtgtctttatagcagcatgatttataatcctttgggtatatacccagtaatgcattatttcaattaattggacagcttagatgaattgggtagaatgtagggaaaggacaaccttctgaaaatgacacaaacagaaactgacacactcctatctctttccaagtaatgaactaaccttacctgtagaaaatatgatagtgtttcagaaaaccctaaagaatctacagacataattgaacatagttaaatttcccttataaatactagcaacaaggacattggaatttttttttaatgaaaaacctttgatgaaatctgaaaacataaacacttaggaatagataaggaagatccataataaaaactacaaaactctccaaaaataatcatttaaaatacgtaacagatatattgtattcaggaattagaaaacccactattgttaagatattattagtacaagatgatttatggatccaacttgaataaaactccaacatgctccttttgagatgtagacaattgttctgcatgctgctctgtgaaatgattttaccacttcccactcaagggttatcatctatttctgtaaaacatcaaatctggggtggtcatgtgaccactcgtttgaatagaatatgatgcaagtgacattgcaccagttatggacatagcacttacctggccaaactcatctatgttctaccactgcgatctctgagcaccatacaaaaagtgtggctattctctggagtgatctcgtggtcctttatctaaagagataggagaaggaacacagtgcatctcttaatgtcatcccttctaatatactataaatgtgaattaagttatcctgcctcttacggaacatttagttatcaggtgaataagagagtgacttcactccttgccacacaaaacagaagaagcaccctgccaacaactgcctgaattcctggctcacaaaattttgatataaaatgaaatgatggttgtttaactcacaaaaactgtggaaccctgaacattacatgaagacagaaccagaataaaagtgacatctcaaggcgtggagtttccataactacaatttaaagtgtatggaattggctttagtgtccaaaaataggggccaccaggacactgtaagtgaatgctcaaaagacagaagtaactattccagaagctgtgaaaatttgacttgtgatgcaatgctgaaaaaatttagtacctctgtcacccataggaaggtagaaaatgaaaaatatacataagtaaattggtggatatggctaaaatttccaagtagaatactgaaaatttcagctgtttcttacagcagtgtatcatataataaggcatagatatttaaaaaacactaatgaggggtggagcaaagatggccgaataggaacagctccagtccacagctcccagcatgagcgatgcagaagactggtgatttctgaatgcccaactgaggtaccggattcatctctctggggagtgttggaaagtgggtgcagtgtagtgggtgcagtgcaccgagcatgagccgaagcagggcgaggtaacacctcacctgggaagtgcaaggggtcagggaattccctctcctagtcaaagaaaggggtgacagatgacacctggaaaatgagatcactcccaccctaatactgcacttttccaacagtcatagcaaatggcacaccaggagattttatcctgcacatggcttggggggtcctaagcccatggagccttgctcattgctagcacagcagtctgagatcaaactgcaaggcagcagcaaggctggggtaggggcacccgccattgccaagccttgagtaggtaaacaaagcggcctggaagcttgaactaggtggaacccaccgcagctcaaggaggcctgcctgtgtctctagacaccacctctgggggcagagcattgccaaataaaaggcagcagaatcctctgcagatttaaatgtctctgtctgacagctttgaaggagtagtggttctcccagcatgcagctggagatctaagaacagacagactgcctcctcaatgagtccctgaccctcgagtagcctaactgggaggcatccccaaatagaggcagactgacacctcacacggccgggtactcctctgagacaaaacttccagaggaatgatcaggcagcagcacttgctgttcaccaaaatccactgttctgcagcctccgctgctgatacccaggtaaacagggtctggagtggacctccagcaaactccaacacacctgcagctgagggacctgactgttaaaaggaaaactaacaaatacaaaggacatcgaaaccaaaacaccaactgaatgtcaccatcatcaatgatctaatgtagataaaaccacaaagatggggaaaaaaagagcagaaaaactggaaactctaaaaatcagagcacctctcctcctccaaaggaatgcagctcctcaccagcaatggaacaaagctggatggagaatgactttgacgaattgagagaagaaggcttcagaccatcaaactactctgagctaaaggaggaatttcaaaaccatggcaaagaagttaaaaaccttgaaaaaaaaattagacgaatggctgactagaataaccaatgcagagaagtccttaaaagacctgatggagctgaaaaccaaggcatgaggactacgtgacaaatgcacaagcctcagtacctgattcaatcaactggaagaaagggtatcagtgatggaagataaaatgaatgaaatgaagcaagagagaagtctagagaaaaaagaataaaaataaatgaagcctccaagaaatatgggattatgtgaaaagaccaaatctacttttgattggtgtacctcagagtgacggggagaatggaaccaagttggaaaacactctgcaggatactatccaggagaaattccccaatctagaaaggcaggccaacattcacattcaggaaatacagagaaccccccaaagatactcctcaagaacagcaactccaagaaacataattgtcagattcaccaaagttgaaatgaaggagaaaatgttaagggcagccacagagaaaggtcgggttacccacaaagggaagcccatcagactaactactgatctctcagcagaaactctacaagccagaagagagtgggggccaatattcaacaggcttaaagaaaagaattttcaactcagaatttcatatccagccaaactaagctttataagtgaaggagaaataaaatcctttacagacaagcaaatgctgagagattctgtcaccaccaggcctgccataaaagacctcctgaaggaagcaataaacacggaaaggaacaaccagtaccagccactgcaaaaacatgccaaatcgtaaagaccattgaggctaggaaaaaactgcatcaactgactagcaaaataactagctaagagcataatgacaggatcaaattcacacataacaatattaactttaaatgtaaatggtctaagtgctccaattaaaagacacagactgacaaattgaataaagagtcaagacccatcattgtgctgtattcaggaaatcaatctcacatgcagagacacacataggctcaaaataaaaggatggaagaagatctaccaagcaaatggaaaacaaaaatccaggggttgcaatcctagtttctgataaaacagactttaaaccaacaaagatcaaaagagacaaagaaggccattacataatggtaaagggatcaattcaacaagaagagctaactatcctaaatatgtatgcacccaatacagaagcacccagattcataaagccaatccttagagacctagaaagagactcaaactcccacacaataataatgggagactttaactccccactgtcaccattagacagatcaatcagacagaaagttaacaaggatatccaggaattgaactcagctctacaccaaggagacctaatagacatctacagaactctccaccacaaatcaacagaatatacattcttctcagcaccacaccacacctattccaaaagtgaccacatagttggaagtgaagcactcctcagcaaatgtaaaagaacagaaattattataaactgtgtctcagaccacagtgcaatcaaactagaactcaggattaagaaactcactaaaaaccgctcaactagatggaaactgaacaacctgctgctgaatgactactgggtaaataatgaaatgaaggcagaaataaagatgttccttgaaaccaatgaaaacaaagacacagcataccagaatctctgggacacattcaaagcagtgtgtagagggaaatttacagcactacatgcccacaagagaaatcaggaaacatctaaaattggcaccctaacatcacaattaaaagagctagaaaggcaagggcaaacacattcaaagccagcagaaggcaaaaaataactaagatcagagcagaactgaaggacacagcgacacaaaaacccttcaaaaaatcaatgaatccaggagctggttttttgaaaagatcaacaaaattgatagaccactagcaagactaataaagaagaaaagagagaagaatcaaatagacgcaataaaaaatgataaaggggatattatcaatgatcccacagaaatacaagctaccatcagacaatactataaacacctctacgcaaataaactagaaaatctaggagaaatggacaaattcctgggcacatacaccctcccaagactaaaccaggaagaagatgaatctctgaatagaccaataacaggctctgaaatagaggcaataattaatagcttaacaaccaaaaaaagtccaggaccagacggattcacagccgaaatctaccagagatacagggaggagctggtactattccttctgaaactattccaatcaacagaaaaagagagaatcctacctaactcattttatgaggtcagcatcatcctgataccaaagcctggcagagacacaaccaaaaaagagaattttagaccaatatccctgatgaacattgatgcaaaaatcctcaataaaatactggcaaaccgaatccagaagcacatcaaaaagcttatccaccatgatcaagtgggcttcatccctgggatgcaaggctggttcaacatacccaaattaataaatgtaatccagcatataaacagaaccaaggaaaaacaccatatgattatctcaatagatgcagaaaaggcctttgtcaaaattcaactacccttcatgctaaaaattctcgataaattaagtattgatgggacatatctcaaaataataagaactatctatgacaatcccacagccaatatcatattgaatgggcaaaacctggaagcattccctttgacaactggacaagacagggattccctctctcaccactcctattcaacatagtgttggaagttctggccagggcaataggcaggaaaaagaaataaagggtattcagttaggaaaagaggaagtcaaattttccctgtcacagatgacatgattgtatatctagaaaaccccatcgtctcagcccaaaatctccttaagctgataggtaacttcagcaaagtctcaggatacaaaatcaatatgcaaaaatcacaagcattcttatacaccaataacagacaaacagagagacaaatcatgagtgaactcccattcacaattgcttcaaagagaataaaatacctagaaatccaacttacaagggatgtgaaggacctcttcaaggagaactacaaaccactgctcaatgaaatagaagaggatacaaacaaatggaagaacattcgaatctcatgggtaggaagaatcaatatcgtgaaaatggccatagtgcccaaggtaatttataaattcaataccatcctcatcaagctaccaatgactatcttcacagaattggaaaaaaactactttaaagttcacatggaaccaaaaaagagcccgcattgccaagtcaatgctaagctaaaagatcaaagctggaagaatcacgctacctgacttcaaactatactacaagtctacagtaaccaaaacagcactgtactggtaccaaaacagagatgtagaccaatggaacagaacagagccctcagaaataatgccacgtatctacaacaatctgatctttgacaaagctgacaaaaacaagaaatggagaaatgattccctatttaataaattgtgctgggaaaactggctagccatatggagaaagctgaaactggatcccttccttacaacttatacaaaaattaattcaagatggattaaagacttcaatgttagacctaaaaccatcaaaaccctagaagaaaacctaggcaatatcactcaggacataggcatgggcaaggacttcatgtctaaaacaccaaaagcaatggcaacaaaagccaaaattgacaaatgggatctaattaaactaaagagcttctgcacagcaaaggaaactaccatcagagtgaacaggcaacctacagaatgggagaacatttttccaacctactcatctgacaaagggctaatatccagaatctacaatgaacccagacaaatttacaagaaaaaaacaaacaaccccatcaaaaagcgggcaaaggttatgaacagatacttttcaaaagaagacgtttatgcagacaaagacacgtgagaaaatgctcatcatcactggccatcagagaaatgcaaatcaaaaccacaatgagataccatctcacaccagttagaatggcgatcattaaaaagtcaggaaacaacaggtgctggagaggttgtggagaagtaggaacacttttacacttttggtgggactgtaaactagttcaaccattgtggaagtcagtgtgacgattcctcagggatttagagctagaaataccatttgactcaaccatcccattactgggtatatacccaaaggattataaatcatgctgctatgaagacacatgcacacgcatgtttattgtggcactattcacaatagcaaagacggaaccaagccaaatgtccaacaatgatagactggattaagaaaacgtagcacgtatacaccatggaatactatgcagccataaaaaaggatgagttcatgtcctttgtagggacatggatgaagctggaaaccatcattctcagcaaactattgcaaggacgaaaaaccaaacaccacactgtctcactcataggtgggaattgaacaatgagaacacatggacacaggaaggggaacatcacacaccggggactgttatgggatggagggagtggggagggataccattagggatatacctaatgttaaatgacgagttaatgggtgcagcacaccaatggtgcatgtatacatatgtaccaaacatgcacattgtgcacatgtaccctaaaacttaaagtataaaaaaataaataaataaataaagaacaccagtgaaaagattaaccattacatattcgacataatttacaagaaacataaaagaacaagaaattgttggtttcaaacataaaagtggttcccctttccactgtctgcaagagctaagtactctaaacccaagaaaggtcatcaaaataaatgtcatttgaaagttatggatgttatgacacttagaaagactacagaaaaatttaacggtgtgtctcataagtaccttaaactagagaatcataattctaagattcttaaagtgttatatgactgcatatagagtttcagcccaagtctgggatggaccagtttcaaagatatttttgagtatggtccttgtatattccacaaaatctttaaaaacttacactaagggaagcatcacagccttcccttctgaacaggggcatccattttattacctattcctctctttctccattgtgtgctgagaatgtggaggaaataccctgtctcaaagatctgtaaatagtaaaagccataatttaaaatgtgcacagtaaaacccgcccccaaggagccccatccacactcagtctcgatgtagaagttgagatcttgaacttcaatcagatgtcatgatgggatgactttgtaattgagctaggagcatccaaatcctgtcttctttctttgggatccttgacttgcccttagaaacctgaaaacttcactgggaagaccttgactacatacctccttacctacatgaggacggacactcctcctataataaatatagttaactttttacccaagagtttttctatagcatttctcatctctgaatttctcaacgtatatattaaaggactcagcatgtgtgtgataatggtataaaacacagtcatgaacttatcagtaggaaagtttgaaacaggtctaacatatatgaaaatacagggtacaaaaaagaggacaacaacggtactgccggagctgcaggtagacaaggctttacccctcttttcctgactgtaagttttaagggagcttaggatgactccataggagattaacagaaggttgaaaatgaccatacagattgctccactattgacaacaacagtgaggcctataaagtaggtgtcagtgcatgccagttccagtaatgggtgcatgtcacaactgaaatgaacaatgacattgggaccacagaaagggagactgtacacaacaatttgaaacgcagaatgtacaaaacctccaatcatggccaccaccaacagaaggaagcaaacctgtcgattcatgatggtcaaatagtgcagtggcttacagatggccacatagcgatcacaggccatcaccaccagaaggaagacctcagccccaccaaagaaatggtctataaatagctggcccatgcaaccttggaaggaaatagtctttttatcacagaataagcctacaattaacttgggagaaatggtagtggaatatgcagcatctataaatgacaggcaggcaaggaagaaatacattggggaacccaaggaagggctggcaataatatccaccacaatgagcaggttccccaccactgtcaccaagtatgtgagtaaaaacatgacaaataatgctttttgcacaccaggatcctgagaaaagcccaggaggacaaattctgtaatattgttattctgtctcatttactcttctttaaggcttgtatcagaggtgagagctcagggaaacagggcctgtaacgaaatagtgatcaggaatatgattacatccattgtgtcacagggcacatcttcattgctgtatcctgaatagtgatttacacataataaatatttagtaagtctctattgagttcctcacccaaagagcccatcttgccctgatgattctatttctcctcaaatattttagtttcagtgcacaggtaaaggcttctacctctaagttttagtgaatattctatatagaagaacagttaaagtcccaacagccatttgtacatttcataatttctgatttaaaacattttattggcatggaagtcagctgtgatgaataggcaatgggtccttcatctcaagaaacttactctctggtggtggtaataaactctaaataaataaattgacatagatttagtcctttatgtttgtacttgtggtatctttgtaatataatctgtatagcaccaagaataatctcttctggaatatctcactcagtactctgaccttctactgctagaacttcattccttcatgcctcaaaggatgttcattagtctttcattaaatgtcaaaagacaagactctgaactgtataaatgctatgacattatttatcacattgttccttgtagcaattacttgatgtgactctctgttctctttataaggatctgtgattctgtccattttatccttgcctgtacacaaatttttacaacacatatatacaatatcctaattttcagcaattaattttgaactcaagtgaactaactcatgactgtcactaactaccgaataagcagttagtacttttttctgaattcttgggaggagctagttagtgagatagaagaaaatagacactgtagaaagagggacatggttttattcataacacaatttagataccaagagtactcaaaaatgtaatcttagttacaagatttcaaaaagaatcatactctaagagaaattccaagttcagtgtaagaaggcacggatttgattctgaatacatttacaagtctgcctcagtttgctcactggaaaacaatgggattaaatttgagaaattcagaatcctttctagtcaattatctacagaactattcatgcacctctcttttatgatattctgctgacaatttgtttttcattttttataaatttataattaaataaaaatttccaagctcatgacgtttacatgaaaaatggtagtcagtgggacatggggtttcatgattacagtgaataaatagtgactatacgtgtctcattcagcatgtacctatttaagatccaagacatctttggagagaaagtgtagcatgtggtgaataatgtggacactggagccacactgcttcagctacaacctcaagttcaccactttttatgagagtttgggccatttactaaagctctctatcccttacttgcatcatttttaaaatgaggagtccaacaacccttacctattagagttgtcgttttattaaaacaaagtaaagtgcctagaacactggctggcacctgggaaggactcaataaatgatagctattattactgtttttgaatgcttcactgtgaacacagaatcagaacaaattattcagatctctgtcaacttgaaaagatttatagacgtagtccaggaaaaaaaaaggataagatacgtacaattcaggaaagcctgttatggccaaacaataaaactctatgtcttagaaaataatgatttaattatgtgagtagtaattttacctgtgatggaacgtatcttagtgaaaagcaagcagaagtatagtaaaaatttggacccaccatcagagggagctcagggaatgaaaagaagactaaaataagaaaacagagaaatcatagttaacaaatgagtatccacaagcaataagaaggttaatgggacaattaagtaattaagtgagattattattcttttaaaattctcttcagaaagattccttttagtgagaaaatgctggaagtgaaacctcctgtcggtccgtggggtgactcaggaggctttttggggtagatgtaacaaaaacaaaccagatactagtaaaagaaaagaaaagaaaagaaaagaaaagaaaagaaaagaaaaaagaaaagaaaagaaaagaaaaacacgcattgttactcttaagtctctagtactgatggttaaggacaaaccaattacagagaacaatgggacaagtagagatacaaacccagactttctgattcttcactgctgaggaaagctgcagaattactaaacctcaaatgtagacaggatggttccatttacatagatctggtagtggaagaggaggtgtgcagagagagtttgggctgtctctagaagtcagctgtgatgaacattccacatgccccacgttaccatttccagctgattccagagttctgtcattgttgaagctatagactgacagagaggcaactgctgaagaacacaagggaataatgtagtctatagccaattctgttatttttttcacaccttacttgctgcaaggtttagtgccttttccctcttccatcatgaaaactagatttcaacaggataatcctttggcaatttaaatgtttacttgtaaaaaatagggtgagtaaaccgtcctctgtagtttaagtaagtaattacaaatggaatactttagaaactgaaagataggattacaagactttcaatgtaaactgctaagttaaagtttttctagaaaaacatgatttaacatagtttcctaagaacatgatattttcaaaagataaaatcccataataacagaaaacctctataatattatatttcacaatcatagttttataaatctatttaaatgacagtagactagatactttcctcagcatatttatctactagtatgtttgctgggattttttagattcgtaagtaaaaacccatattatgcttccagaacataacaggcattggttccttcacactctaacacacttgacatgatctgcaattttaaactccctaatcaaatatatctgaaagtaattgtacacttttattaatatatcatataaaatacaacatctcaaaaattaagattataattataaatctattggtttattaagcatgtagtatggaactttttttttatttaacaaatagaaaagaagaaaaataaattaggctatatattaaaaccaaatatacattgtatgttccaaaaagttttcatgtttcctggctaactttcccaattaaattccttcaacaatatcatatggtatttaagatattagctacatttcctcatatcacaagaattttcaatgaatatctcctgtcactggtttcaaatgctcacactgtaatccagaaaagcaatgcttctttcactgagtgttaatgtagacatctcatgcacctatttgtgatcacagaacatgtaaatatgaatgactgatccagggttagagaactagtttctaatggctacagtttccacaattccacacaggattctcattatctcagttgttacagaggtatggaaatatccaaagcagatgaccaaaatataaagaggcttaaacataatacacaaaggtagttaaataatctcacctgctggaaaatttcttcataaaaaaccaaaaatattatcattgcatgactatgtaaaaattgacctaattaatgaaaattaacctggacaagacccttattttgtgacacaagtgaacaaaaatataccaacactaaaatttgttacatgaaagtttcctcaattatggtgaagtaaccataagtactttactgtgattgaggatttatgataacattcatgtgcccagctattaagctttgtacctaacaaggacaatgctgaaatttaactttatggaaaaaacaatgacagaactttctcacaggcagaagccaaactcttcagtttttcggtcattcagatataattccaatagcgtacccctaaatctacttctttcctaattaaaatcatgtctttatatctccccacctcagcccagtacattgagaactttaacaaatttttacacaacatggaggatatgacaagaaaacaccacacctaaaggactagataccaaatgaagacatgctctaccttgggtagaaatttaactcttcagatatctcttgggttattctatcaggaaaataatatttccatttatgtgtgtagacacaatctatgacttttgcatcatcgtattttaaataaaagagagtgtaaggtcattataggttagttaatttcattatttggaataaattcaaatgaagtaaactctccgaacatctttttttccccctagaaactccctagagggaaaagatttgggcatcaccaaggaagagtagctaaatgccaagtaatgtgaaaagcctataatgtgaaaagaaaaattttaaaataaattgaacaaaaattatgagtttcactttatgaaatactgaggtaaggcaagtaatatttaagccagaatgaagggggaaccagtcccaggttctttaccctaagcacattcccaaaaagaagggctttacatttcctgttagaaattccatgcccaagaagtcctgaggctcagaggcaggcagcctaagaacagaatttgacattctgattcttgaaaaagcaggtaatcatagttctgcagttttagatcagagtaaaggcttttgatcaaggcctgaatctatgtcagatataaccataatgatctatagtccattaattcagttacttaataattgtattccaacatcaattcagtaactgtttctacaataaagaaatttgtatttttcaacaagggagcaatgcttaagggcttccattgttatttccgtgacttggcttaccattggctccattgaacacgttcatctcatcatatgtttagttaaatattggatcttctgtgtcataagagtgttagatacagagtcccataaatacatatctgaaccagctaatgagtttatcatgtattgggctccactaaaagttggtcattttcaacttacctaatacatggatgaaattcatccacaccaaatgtaatctgtatcacttctaaaatttaaagactatgtctgtaagcactgcgctctcttacttgtaagtggtaaaagatgcacaaacgtataattctgaagaactatcagatatgatcaaagataccatggattaaattatgactccaagatggacaactaatatgaaaataaaccaaaattctgtatgtcccttctagctgaattcaaataaccactaattcttcccacttttcagaatgacacaaaagtgtttgttagatcagatgatgcaggagggagaagaagcgacagcaggagaaatgacagacacttatgaaaccatcagatctcattagaactcactcatgatcaagagaacaacatgggggaaaccacctcataattcaaataccctccacctagttccttccacaacacatggggataatggggactacaattcaatatgagatttgggcacaggcaaagccaaactatatcagcatgttaggtactgccaggtatttttaatactgaggatttcagggatcatggtggataggaggcaggactagattgcagctctggaaagagcagcttacggaggcttgcactgtgaattttagctccagaatgactacaacaacacaccagtcatcctgagaggacccacaaaccctctgaaagaagcagactgctcctgcaggacccaggagacacctcaaatactgtgagtgccgtaattggagaagtgggaaacggagaccctcctctcccgaacacacacctgcactagagaagctgaaggtcggtttgcaggagaaattcctgactttacctggagctgagtcaagttagagagccaagccaagaaaaatacaggggtagaggaaacagcagaaaggccctgggggctcactggatccccaagcagcccattcctgtctggcaccacagggatccatcaggagggtggccagaggagcaagcagtgaaactccccagagagaaggacttctcaagctgaactttgtaactatttgaatgggatgagaaacctcctggccagaactcgggggagggctcaaatctggtatgcagacttcacaggtcagggaagaaataaatccctttttttccacacctgagagacagaaagccttgggcaagttttcaagccctacttgccctccacctagaaacagactcagattactatgggggacacggtgtgagtgagacctctccttctgtttgcatgggaactgggtgaggcccatgactgcttgctttcccacacttccctgacatcctgcaggactcagcagaggcacccataatcttcctaggtacacaaaccaatgacctcagaatatcacacccatcccccacagcagccacagccagacccaccaaaggagagtctgagctcagacatgcctagccccacccccaaatgatggtccttccctatccacactggtagcggaagacaaagggcatataatcttgggagttctagggcctcacccacagcctttccctttccacaatactacagctgatgctttctggaaagtgccacctcctggcagaggccaacaagcacaaaaatagagcattaaaccaccaaatctaaggagccctatggagtccattgcaccctccgccacctccactggaacaggcgctggtatccatggctgagagatccatagatggttcattcacacaactctgcagacaacctcagtgcaagcccagagcagggtagactctctgggtggctacacccagatgagagacaaacatcactgtagattggctcacaagaagcaacatccacaggaaaacgtgaaaaatactacatcaagggaacacctcctgggacaaaaaaaattctgaatgacggcctccagccctagaccttccatctggcagagcttacgccaatgagaaggaaccagaaaaccaaccctggtaatatgagaaaacaaggatcttcaacacccccaaaaaatcacactagttcaccagcaattaatccaaaccaagaagaaatccctgattttcctgaaaaagaattcaggaggttagttattaagcaaattagggagggaccagagaaaggtgaagcccaatgcaaggaaatccaaaatgggatacaagaagtgaatggagaaatattcaaagaaatatatagcttaaagaaaaaaacattcaaaaattcaggaaactttggacacactgttaaaaatgtaaaatgctctagaaatactcagaaatagaattgaacaagtagaagaaagaaattcagagctcgaagacaaggtgtttgaattaacctaatccaactgagacaaagaaaaatgaataagaaaatatgagcaaagcccccaagaagtcttgaacttcattaaatggccaaaccaaataataatcagtgttcctgaggaaaaagaaaattctaaaaacttgggaaacatctttgggaaaataatagaggaaaacttccccagccttgctagagacctagacatccaagtacaagaagcaaaaagaacaccaggaaattcatctcacaaggaggtcttggcctaagcacattgtcaccaggttatccaaagttaagacaaaggaaagaatcttaagagctgtgagacagaagctccaggtaacctatacagaaaaacctatcagattaagagcagatttctcagcagaaaccctacaatgcggaagggattggagctctatcttcagcctccccaaagaaaacaattatcgaccaaaaattttgtatccagaaaaactaagcatcatgtatcaaggaaagacagtctttttcagccaaacgaatcctgaaagagtttgccattaccaagccaccactacaagaactgctaaaaggagcttgaaatcctggaacaaacctgaaaacaccaaaaaacagaaactctttaaagcataaatcacacaggacctgtaaaacaaaaatacgttaaaaagcaaaaacaaaagaaccaaagtacacaggcaacaaagagcacaatgaatgtgatggtgctgtcatttcaatattaacattgaatgtaactggcctaaatgcttcacttaaaagatacagaactgccgaatggataagaactcaccaaccatctgctgccttcaggagactcacttaacacataaggactcacataaaataaaagtaaagatgcggaaaaaggcatgtcatgcaaatgggcaccaaaagaaagcaagcaggggtagctatgcttatatcagacaaactttaaagcaacagcagataaaagagacaaagcaggacattatataatggtaaagcaacttgtccaacaggaaaatatcacaatcctaaatatatgtgcacctaacactggaactctcaaatttataaaacaattactaatagacctaagaaatgacataggcagcaacacaataatagtgggagtcttgaatattccaatgacagtactggacaggtcatcaacagaaagtctacaaagaagcaatggatgtaaactatacctgggaacaaatgggattagcagatgatatatacagaacatttcatccaacaaccacagaagacactttcgattcagcagcacacagaactttctccaagacagaccataagatagaccataaaatgagccttgataaatttaaggaaactgaaattatatcaagcactctctcagatcacagtggaacaaaactggaaatcaacacaaaaaggagcctttgaaaccatgcaaatgcattataatttaaaaacgtgctcctgaatgagcattgccacaaaaacaaaatcaagatggaaattaaaaaattcattgaactgaacaacaataatgacacaatatatcaaaacaccaagcagacctaatagacatctacagaactctccaccccaaatcaacagaatatacattcttttcagcaccacaccacaactattccaaaattgaccacatacttggaagtaaagcactcctcagcaaatgtaaaagaacagaaattataaaaactgtctctcagaccacagtgcaatcaaactagaactcaggattaagaaactcactcaaaatggctcaactacatggaaactgaacaacatgctcctgaatgactactgggtacataacaaaatgaaggcagaaataaagatgttcttggaaaccagtgagaacaaagacacaacataccagaatctctgggacacattcaaagcagtgtgtagagggaaatttgtagcactaaaagcccacaaagaaagcaggaaagatccaaaattgacaccctaacatcacaattaaaagaagtagaaaagtaagagcaaacacattcaaaagctagcagaaggcaagaaataactaaaatcagagcagatctgaaggaaatagagacacaaaaaacccttcaaaaaattaatgaatccaggagctggttttttgaaaacatcaacaaaattgatagactgctagcaagaccaataaagaagaaaagagagaagaagcaaatagatgcaataaaaaatgagaaaggggacatcaccaccaatcccacagaaatacaaactaccatcagagaataccaaaacacctctatgaaaataaactacaaaatctagaaggaatggataaattcctcgacacatacatcatcccaagactaaaccaggaagaagttgaatctctgaatagaccaataacaggatctgaaattgtggcaataatcaatagcttaccaaccaaaaaaagtcaaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagtccaatatctttgattaacattgatgcaaaaatcctcaataaaatactggcaaaccaaatccagcagcacatcaaaaaatttatccaccatgatctagtgggcttcatccctggggtgcaaggctgggtcaacatatgcaaatcagtaaatgtaatccagcgtacaaacagaaccaaagacaaaaaccacatgattatctcaatatgcggaaaaggcctttgacaaaattcaacaacccttcatgctaaacactctcaataaattaggtactgatgggacatatctcaaaataataagagccatatatgacagacccacagccaatatcatactgaatgggcaaaaactggaagcattcccttggaaaactggcacaagacaggcatgccttctctcaccactcctattcaacatagtgttggaagttctggccaggacaatcagacaggagaaggaaataaagtgtattcaactaggaaaagaggaagtcaaattgtccctgtttgcagatgacatggttgtatatatagaaaactccattgtctcagcccaaaatctctttaaactgatgagcaacttcagcaaagtctcaggatacaaaatcaatgaacaaaaatcacaagcattcttatacaccaataacagacaaacagagagccaaatcatgagtgaattcccattcacaattgcttcaaagagaagaaaatacctaggaatccaacttacaagggatgtgaaggacctcttcaaggagaactacaaaccactgctcaatgaaataaaagaggatacaaacaaatggaagaaaattccatgctcatgggtaggaagaatcaatatcatgaaaatggccatactgcccaagataattgatagattcaatgccatccctatcaagctaagaatgactttctcacagaattggaaaaaaattactttaaagttcatgtggaaccaaaaaagagcctgcatttccaagtcaatcctaagccaaaagaacaaaggccggaggcatcatgctacctgacttcaaactatactacaagtctacagtaaccaaaagagcatggtactggtaccaaaacagagatatagatcaatggaacagaacagagccctcagaaatattgccgcatatctacaaccatctgatctttgacaaacctgatgaaaacaagcaatagggaaaggagtccctatttaataaatggctctgggaaaactggctagccatatggagaaagctgaaactggatcccttccttacaccttacacaaaaattaactcaagatggattaaagacttaaatgttagtcctaaaaccatcaaaaccctagaagaaaacctaggcattaccattcaggacataggcatgggcaatgacttcatgtctaaaacaccaaaagcaatggcaacaaaagccaaaattgacaaatgggatctaattaaactaaagagcttctgcacagcaaaagaaactaccctcagagtgaacaggcaacctacaaagtgggagaacatttttgcaacctactcatctgacaaagggctagtatccagaatctacaatgatctcaaacaaatttagaagaaaaatcaaacaaccccatcaaaaagtgggcgaaggatatgaacagccacttctcaaaagaagacatttaagcagccaaaagacacatgaaaaaatgctcatcatcactggccatcagagaaatgcaaatgaaaaccacaatgagataccgtatcacaccagttagaatggcgatcattaaaaagtcagaaaacaacaggtgctggagaggatgtggagcaataggaacacttttacactgttggtgggactgtaatctagttcaaccattggggaagtcagtgtggcagttcctcagggatctagaactagaaataccatttgactccgccatctcattactgcgtatatacccaaaggattataaatcatgctgctatgaagatacatgcacacgtatgtttattgtggtactattcacaatagctaagacttggaaccaacccaaatgtccaacagtgatagactggattaagaaaaggtggcagatatacacaatggaatactatgcagccataaaaagggatgagttcatgtcctttgtagggacatggatgaaattggaaaccatcattctcagcaaactatcgcaaggagaaaaaaccaaacattgcatgttctcactcataggtgagaactgaacaatgagaacacatggacacaggaaggggagcatcacacaccggggactgttgtggggtggggggaggggggagggatagcattaggagatatacctaatgctaaatgacgagttaatgggtgcagcacaccaacatggcgcatgtatacctatgtaacaaacctgcacattgtgcacatgtaccctaaaacttaaaagtataataataataaaattttaaaaaaagaaaaaagaaaactaaagaatgtacagaatcttaataatttctatactgaatacttattgaaatcaaaatatttaagatatattgggttaaataaaatatactactaaaattaaaaaaaagaaagaaaaagaaaacagcccaaacttgctggttccaaaaataaaactggtttccctttccagtctctccaaagatctaaagactctcaatgttaataatgtcacctagcttctaatattaaagacaatgccacatgctttaagtgtcagaaataaaagtcatatcaaagttgtcaatggaaggtcctttgagaagacttcagaaagattttaaagtgtgtttcataaatcctaccaatgaaacaaaaataattctaagactcctatggtaattatcccactgcacacacacggactctcagctccaacccaagaagagtcagttgcaaagatatttgtgagtgtggctcttgtatagtgttttaaatgacaatttaaaaaacacagaaatattacaatgttttttaggaaattgcattgaaggaagcaccttagcattttcttgtaaacagtagtgtctatttttggttatttactcctctcttcctccattgtatgctgagaatgagaaagaaaaaccctgtctctagtccatagacctgaaaatagagaaccagaataaaagagctgtgcattggaaattgtaccccaagagctttgtcaacactcactctggatatagaatttgacatcctggatgtcaaattgagctcatgatgggacaagatgttaactgacctgggaactcctgaatcccgctttcccaatctaggatccctgaattgccattacaggtctaacaaactcgctggaaaggctttacctgcattaccctgtacctacatgaaaatgtaccctcttattctatctagagttaatatttacaccagaggtttcctatagcatttttcatctctcagtttctcaatgtgtatattaatggattcaacatgggtgtgataactgtataaaacacagtaatgaatttattaataggaaagtttgaaacaggtctaacatacaggaaaatacagggaacaaaaaacaggacaaccacggtaatgtgggagctgcaggtagacagggctttatgcctcccttcctgactataagttttaagggagattaggatgaccccacaggagattagtagaaggatgaacaagaccatacagattcctccaccattggcaacaacagtgaggcctataaagtaggtgtcagtgtgtgccagttccaataatgggtacatgtcacagaaaaagtggtcaatgatattgggaccacagaaaaggagactgtacgcaactaaaatttgaaacacagaatgcacaaaacccgcagtgacagccaccaccaacagaaggatgcaaacctgtcaattcatgatggtgaaatagtgcagtggcttacagatggctacatagcgattataggccatcaccaacagaatgaaggcctcagcaccaccaactaagtggtctataaaagggctgacccatgcaagctcggaaggaaatagtctttttatcatggagatagcttacaatcaatttgggaggaatggtggtggaatacacaacatctataaatgacaagcagacaatgaagaagtacactggggagcctaaggtgggggtggcaataatagtcaccacaatgggcaggttccccaccatagtcataatgtatgtgagtaaatgtacgacaaataatgcattttacacatcaggatcctgagtaaggcctaggaggacaaatgctgtaacatcgctactcagtctcattttctattctctgaggcttgtatcagagtaaagagctcaggagaacaggacctgtaacaaaatactgaacaggaatatgaacacatccacgatgtcacagagcacttcttcatcattgtatcttcaatagtgatttacacacatgataaacattttgtaagtctctattgagttcctcatctcctcaaagattttcgtttcagcctacagttaacagcttctgcctctaagttttagtgaatattctgtacagaagaagagttaaatgcccaacagccattcatatatttcataactccttatctaaaacatatttcttggcacagaagtcagctatgatgaataggcaacagattattggtctcaagaatgttactttctcatggtggtaatagattctaaataaataaattcgtgtatattcagtgctttgagtttgtagttcttgtagtatctttatgatctgtgtagcatcaaaagtaatatcttctgaaatatctcactcagtactgtggcattccacagtcacacattcagtccttcatgcctcgaaagatgttcagtctttatgaacacctcattaaatgtcaagagactggacattaacctgaataaatagcaaaatattatttatcacattattccctgtagcaattacttggtctgaccctctgttgccttataaggagctgcacatctctgcatcttattcttgcctattccacaattttttaatcatatttacatacagtatcctgattttcaccaacaaattttgaactcaagaaaactaactgatggctatcaccaactgccacattagctgtgagttttttttctgatttcttggggtgaactagatagtgagagaggagaaaataaacaccgtacaaaaaggtacagaacagaggacactgttttatttttaacactatttagataccaagagtattcaaaaatagaaccttagtgtccagattccaaaaaaagcatactgaaagagaaagtccacgttcactgtaagatgacatcaatttgagtcattttctgaatgaatttacatgtctgtctcagtttgctcactggaaaacaatgtgattgaattagatgaactgagaatcgtttccagtcaaccacctacaaaactattagtgcacccctcccttattatattctgctgactctttcatttttcatatatttataattaaatagcaatttccaagctcataactgttacatgaataacggtagtcagtggtagatgtttcatgattagagtgagtaaattatgactacaagtttcccactcaatatgtgcctatttaagattcaagaaatccttggaaacaaagtgtagcatgtggcgaataatggggacaaaggagccacactgcctcagctacaagcccagtttcaccacttactatatgattttgggccacttactaaactgctctttgcctcattttcatttgaaacatctagagttcttttattacaacaaagtaaagtttcctagaacactggctggcacctggtaaaggcccagtaaaagacagctaatacttgtgttcctgaatgcttcactgtgaacactggatcaaaacaaatcatgctgctataaagacacatgcacatctatgtttattgtggcactattcacaatagcaaagacttggaaccaacccaaatgtccaacaatgatagactggattaaaaaaaaatgtggcacatatacaccatggaatactatgcagccataaaaaatgatgagttcatgtcttttgtagggacatggatgaaactggaaaccatcattctcagcaaactatcgcaaggacaaaaaaccaaacactgcatgttctcactcataggtgggaattgaacaatgagaacacatggacacaggaaggggaacatcacacactggggcctgttgtggggtgggggaggggggaaggatagcattaggagatatacctaatgttaaatggcaagttaatgggtgcagcacaccaacatggcacatgtatacatatgtaacaaacctgcacgttgtgcacatgtaccctaaaacttaaagtataattaaaaaaaaaacaaatcatctgcatctttgtcaatttgaaaatatttataggcatagtccagaggaaaaaataatagaagacacatataattcaggaaaagcttttggggacacaatataattttatgtcttaggtattatccatttaattatgtatgagtagtgattttatctgtgatggaaagtatcttgacaatatcaggcagaattatagtagaaaatttggacccatcatcagacagagagctaaatggttaaaaaaatgaaagaaaaagtgatcaaatcggaaaacagagtaattacaataaataacttaatgtccatgggtaataagaagataaaaattaatgtgataactgagtctagtgttcttctaaaaatcttcagagagtgaggaaatactggaagcacaacccgctgtggtccctgaggagactcaagaggcttcttggggtagccaaacaaacacagagcaaatcctaataaacaccaaaaagaaaagaaaagaaaactcagaagaaaaacaaaacacattgatttatcaaagtctctccatctgatggttaaagacaaacttaaattatagagaacaatgggacaagttgagataaaaacccagactttgtgattattcactgctgaggaaaactgcagaattactaaacctcgaatgtagacaggatgattccatttacataaatctggcagtggaagaggacgtgtgcagagagagtctgagctgtctctagaagccagctgtgatgcactttccacatgtctcattcatgttaccacttccagctgacaaagcgttctggcactgttgaagctatagacttatagagatgcacatgctgaagaacacaagagaataatgtagcctatagcgaattctggtttttttttttacatcttgcttgctgcaaagtttagtgtgttttccccctttcaccatcaaaactacattcaacaggaaaattctatttgggaatttaaatgtttacttgtaaaactagggtataaaattatcctttatagtttaaatagttaaaaacataatactttaaaagctgaaacatagcattactaggctttcaatgtaaactgctaagttaacaattttctagaaaaaatgatctaatataatttcctgagttcatgccattttcaaaagataaaattctgtaataacacaaaaacatctataatattatgtttcacagtcacagttttataaatctatttaaatgacagctgactaggtaccttcctgaccataggtatccattagtatgtttgctgaaataatttttagattcataagtaaaatcctgtattatgcttccagaacataacagacatttgttcatttacacttcaacaaacttgacatgatccagaattttaaattctctaatcaaatatatctgaaagtaattgtacacatttattaatatatcatataaaatataatatcacaaacactaagattacacatctattgattcatttattattaggtgtaatatggaacatgtttttcttcttatttgacaaatggaaacatacaaataggctgtatattaaaatcaaatatacattgtatacattgataaatttccatgtgtgctagcttaatttttccaattagaatttatcaaataaaaccattggtttttaagatattagctacatttcaacatatcacaggaatttttaatgaattatctcttgtcaatggtttcaaatactcacatcttggtccagaaaagcaatgcttctttcactgaggattgccatagatacctcatgcctctatgtgtcctcatgaaacacaggaatatacgtggctgatccatggatatagaactagttcctagtggctacagtttccacagttccatgcaggcttctcattatcttagtctttagagaagtatagcactatccaaagcagatgaccaaactataataatgctttaagataacgacaatatttactgtgaaaggtaattgaatattctcacgtgctggaaaatgccttcgaagaaaaacaaagagactgtctctgcttgactatgtaaaagtggaactaattagtggaaattaacctggacaacacccttttatatgacacaagtagcaacacttatatttgttacttgaatattttctcaattatagtgaagcaaccacaggtactttactgtcattgaggatttataacattcatgtgcccagctattaagctttgtacgtaacaaggacaatgctgagatttaacttcatggagaatccagtgacagagcttcccacaggcagaagccaaactcttcagtctttcagtcattcaactagcatatccctaagaccacttctttcctaagtaaaagcatgtctctatatctccccaatctcatcccaggaaattgagaactttcactcatttttacaagcaatggtagacattgcaagaaaatattacacctagaggactagataccaactgaagacatactctaccttgggcagaaatttaacttttttgatatctcctgggctgctctatcagaaaaataattcttccatttatgtctgtagacacagtctataacctttacatcaacaatattttagaaagagagagtaacgtcactatagattagttagaatatttggaacaacttcaaatgaaataaactctctgtatacttttttcttacaaaattcctagaggaaaaagatttggttcttgctaaggaaaagtagctaaatgacaagtaatgtgaaatgcctgcaatatgaaaagaataattttaaagtgaattgaataataagttatgagatgcatgttatgaaatatttaggtaaggcaagtaatatttcagccagaattaaaggagaaccagccccaggttctctttgctaaaaatgctcccggtgaggagggccttacccttcctgttagaaagtctgtgcccaagaagccccgaggctcagaggcagagagcctaagaacggaagttgacattctgattcatggaaaaataggtaatcatagtgctgcagttttagttagagtacaggcttttgaggcttttgatcaagacctgtatctaagtcagatataaccataatgatcagtagtccattgatatggtttggctgtgtccccacccaaatctcaacttgaactgtatcttcctcatttttctcttgccactgccatgtaagaagtgccttgcacctcccaccatgactctgaggcctttcaagccctgtggaagtgtaagtctaattaaacctctatttcttcccagtcttgggcatgtcattatcagcagtgtgaaaacggactaatacatccattaactcaatattttaattatattctaatatcaatccaataactgtttctacaataaagaaatttttatttccaacaaggaagcagtatttaagggcttccactgttatttccatgacttggcttaccattggatctattgaacaccttcatctcatcatatgttgagctaaatgtttgatctttgtgtcataagagtcttaaagagtcccataaatacctatctgagatagttaaggtctttatcacataacaggctacactaaaagttagtcattttcaacttagctagtaaatggtttaaacacatcaccccaaatgtaatatgtattactgctaaaattcaaagagcatgtctatacgtgctgtgctgtcttactggtaagtgttaaaacatgcacgaaaatatttttattctgcagaactatcagatatgatcaacgatactgtggtctaaattatgattccaagatgaagaactaatataaaaatatgacctatatcccaataccagagtggaagaggatgcttcctcagccaagctttcatatgagatggtagccccaaccatcaccttgattacagttttgtgagagaccttgaaggatgggaacctaagccatccttagtttcctgacctacagaaattgagaatgagtacatattgtttgaatcactaaattttgaaataatttcctttgtataaataaataactcataaatatatctagagtatgcttcaaatattgggaagcatgccaataaatatttagtgaacctatgaatcaaagaaaaaagtataatgtaaataagcaaatatttagaactcagcaataacaaaaaacaccaaaatgtttgaggtgtgatcaaaacagtacttaaagtaacatgtatagctataaaagcttacatttaaaataaatatttacaagcaggcatctgagccttcaccttaagaagctagaacaagaacagtaaataaaagccaaggtaagtaaatgaaaggacataaatataagatcaaaaacaataaaatggaaaacataaaatagagaaaatgaaaatagccacaagttggtaatgaaattgataaattgccagcaagagttatcaaaggaaagacaaattcaaattaccaatatcagaaatcataaaacaaataatcaacccatagatcttttagacttaaaaggttagaaaaggattgttctgaaatacattatttcaattagtttgacggcttagatgaattaggtaaaatgtagggaaagaacaaccttctaaacatgacacaaaaagaaactgaaacatcccatctctttccaagtaatgagctatccttacttgcagataacatgatagtgttagagaaaaccctaaagaataactttgtaggaataagaagtaaatttacaagtttataggactaaaatgtcaaataaaaaatgcaatttcctttacatacatactagcaacaatgacaaatggattttttaattaaaagtctgtgatgaaatctgaaaacataaatacttatgaatagataaggaagatccctacatgaataacaactacaaaactcttcaaaaataaatattttaaatacctaacagatatactgtattcaggaattagaaaacccaatgttgctcagatgttgttagttcaagatgatttatggatctaacttaaaatgaataaaactacaatatgctctttttgagatgtggacaattttcctgcatgctgatctgcaaggtgactttgaaacttccgcatcaaaggttatcttctatttctgtaaaacctcaaatctgggtggtcatgtgatcactatgacaaatagaatatgatgcaagtgacattgtttcagctccggacacagcccttagctggccggacccatttactttctaccactgggatctctgagcacgatgtaaaaagccagactatcctctggagtgatcttgtgttccttcatctaaagggataggaagaggacccaatgcatctcttaaggtcatcccttccaatatgctttaaatgtgcattaagttatcctgcgtttacataaaattcagttatcagctgaataagacagcgacttcagtccttgccacacaaaacagaagaaacacccagccaacaactgcctgaattcctgactcacaaaattttgagataaaataaaatgaaggttgtttgaaatcacaaaaactgtggagccctgcaccatacatgaagacaggacgagaataaaaagtgacaccttaaagtgtggtgtttccataacaacaatctaaagtgtttggaactggctgtagtatataaaaccaagggcctccatgatattgtaagtaaaggctgaaaatagacataactgtttagtaattctgttacctgtagtaaggtagaaaataaaaaatgtacttaaatgaataggtggatacgactaaaatttccaaacagaatattgaaagttacagctgtttattatagcattgtatgttataataagtcagatttttaaaataatactacttaaaagattaactgttacattttcagacagaatttacaagaaacataaaagagtcagaacttgtgggtgtcaaagatgaaaatggtttccctttccagtctctgcaaagagctaagtactctaaaagtaagagtggtcatcaaattaaaagtcattctgaacttgtgggtgtaaagacactatgaataaacttcagaaaaatttaatggtgggtcacgtaactatcttaaactagacaaatttaattccaaggttcttaagagtattatctgactgcacagagagtttcagctcaagtctgagaaggggcagtttcaaagatatttgtgaatatggtgcttgcctattccacaaagtctttaaataaattacacagaaggaagcaccatagccttcccttttgaacaggagcatctattttaattacctattcctccttttctccactctgtgctgggaatacaggagaaatgtcctgtctcaatagatgtgtaatagagaaaatacataatttaaaatgtacacaataggacctgcacccaagcatccccatccactctcagttctggatatagaggttgagatcttgaacttcaaacagatgccaagataggatgacttcttaattgagcttggagcatctaaatcctgtcttcccactttggtatcccaagagattttctatagcatttctcatctctgaatttctcaacatgtatataaaaggattcaacttgggtgtgataactgaataaaacacagtcaggaatttatcaataggaaagtttgaaacgggtctaacatataagaaaatacagggaacaaaaaacaagataaccatgataaagtgggagctgcagataaacggagctttatgcctcccttccggactataagttttaagggagtttaggatgaccccataggagattagtagaagggtgaagatgaccatacagattgctccaccattgaaaaccacagcgaggcctacgaagtaggtgtcagtgcattccaggtccaataaagggtatatgttacagaaaaagtgataaatgacattggggccacagaaagggagactgtacacaactaaaatttgaaacacagaatgcagaaaacctccagtcacagccaccaccaacagaaggatgcaaacctgtcaattcatgatggtcaaatagcgcagtggcttacaggtggccacgtagcgatcataggccatcaccaccagaaggaagacgtcagtatcaccaaacaagtgctctataaatagctgacccatgcaagctgggaaggaaatagtctttttatcacagagtaagtctacaatcaatacaggagaaatggtggtggaatacacagcatctataaatgacaggcaggcaaggaagaagtacactggggagcccaaaaagggactggcaataatagacaccacaatgagcaggttccccaccatagtcacaatatatatgagtaaaaacatgacaaataatgcattttgcacatcaggatactgagagaagcccaggaggacaaattctgtaatattgttattctgcctcatttacccttctttaaggcttgtatcagagatgagagctcaggagaacaagacctgtaatgaaatagtgaacaggaacatgcttacatccattgtgtcgcagagcaccttttcattgttgtatcctcaatagtgatttacacacaataaacatgcagtaagtctctattgtgtttctcatccaaagagtccatcttcccttgacaattctatttctccacaaagattttcatttctgtgacaggtaaaggcttctacctctaagttttagtgaatattctatacagaagaagtgttaaagtcccaaaagccactcatacattttataacttcttatttaaaatatttttcttggcacagaattcagctatgatgaataggcgacaggttcttggtctcaaatgacttcctctctgctgatggtaacaaattctaaataaataattgacatagatttagtgctttgtgtttgtatgtgtggtatctttataatatgatctgtgcagcaccaagaataacatcttctgaaatatatcactcagtactctggccttgtactattagaccttcattccttcatgcctcaaagtatgttcagtctttattagtctttcattaaatgtcagaagacatgactctgaaatgtataaatagctatattatttatcacattgttccctgtagtgattacttggtctgactccttgtccaacttataaggagctgtgattctctccattttgtccttgcctataccccaattttttcaacacttacatacaatatcttaattttaattaatttgaactcaagtgaactaactcatgactatcaccaactaccaaatatgccatgttttttttttcatgaattcttgagatgagctaggtagtgagagaggagaaaatagacactgtagaaagaggtacagaacagtaggacatggctttattcataacactatttagataccaaaagtactcaaaaatagaatcttagctatcagattccaagaagaagcatactctaagagaaattccaaattccatgtaagaagacatggatttgagtcattttttgaatgcaattacaagtctgtctcaatttactcactggaaaacaatgggattaaatttgagaaattcagaatcctttctaatcaactatctacagaactattagtgcatctctcgtttatggtattctgctgacaattttctttttttataaatatataattaaataaaaattttccaagctcatgactgttacatgaaaaatggtagtctgtgggacaatgggttttattattacagtgagtagtgactataagcttctcactgagtatgcacctatttaagatccaagacatcctcaaagggaaagtgtagcatgttgtgaataatgtggacactggagtcacatttcttcagctacaacctcatgttcaccattttttatgagactttgggccatttactaaagctctctgacccttactttcatcatttgtagaatggggatcccaatagtcattacctcttaattgcttgattttcagcaattttgaacttaagtgaactacctgttgatttataaaagaaagtaaagtgcctagaacactggctggcacctagtaaggactcaataaattatagttattatcagtgttcttgaatgcttcactttgaagatagaacaaatcatgtgaatctttgtcaacttgaaaagatttatagacatagtctaggttaaaaagaataaaacactcataattcaggaaaaccttttggggcacacaataaaattgtatgtcttaggaattacaaatttaattatgtatgagtagtgattttctttgtaatgaaatataccttaatgagaagcaagaagaattctagtaaaaaaaagttgaactgatcatcggcaggagagctaaatggtagaaaatgaaagaaaaaggggtcaaatcagaaaaaaagagaaattatagtaaatacattaatattcacaggaaataagatgattaatttcataattaagtgagacaaattagctgggcatggtggtacacacctgctatcccacctactcaagaggctgaggcatgagaatcacttgaatccaggaggcagaggctgcagtgagccaggatcacactactgtcctccagcttgggtgaccgagtgagactatctcaaaaaaaaaaaaaaaaaaaaaagtgaggctagttttctgctaaaaatcctcttcagaaaaatttattttagtgaggaaatactggaagcacaacctcctgtgggtccctgggtgactcaggaggctttgggaatagccataacaaatagacattgactagatcctagtttaaaaaaaaaaagaaaagaaaagacaattcaaaaagaaaaataaaaacaacattgatctcttagtgtctctagatctgacagttaaggacaaacttaaagaaaaaaaacaatgggacaagtagaaatacaaacccaaactttgtgatattcactgctgaggaaaactacagaattactaaatctcaaatgtagacaagatgattccgttcacatagatctgacagtggaggaggatgtgcgcagagagagtttgagctttcttagaagccatttgtgataaacgttccacatgtctcattcacattaccacttccagctgattctagagttctgtcattgctgaagttatagactaacaaaggcacatctgttgaagaactcaagggtattatataacctatagcccattctctttttttcacatcttacttgctgcaagatttatttccttttcactctttcatcatctatgataaatttcaccaggataaatcttctcttgggcagtttagatgtttacttgtaaaaaccaggatatgtaaactatcctctttagcttaagtcatcaaagatttaatactttaaaaactgaaagacaatattactaggcactcaacataaacaactaagttaacacttttctagacaaaaaaacttaagcttcctaagaacgtgactttttcaaatgataaaatcccatagtaacaaaaataatcccttatagataaaatttataaaacaatacggttttgtaaatctctctaaagaatagtaggctcaatactttcctgaacttgtatatgctgagataatttttagattcacacataaaagaccatatcatgcttccagaacatattaggcattgatttctttacactctaacacacttgatatagtctgcaattttaaattttccaatcaaatatatctaaaaataattctatacctatgttaatgtatcacataataaaatattctacatactagattataaatctattggtttacttattttatgtgtaacatggaacatgtttctcctgttacttggcaaattagaaaataaacacttataaggctgtatatgaaaaccaaatgtacttgtatactctgattaatgtctgtgttttgcttgcttaattttcccaattaagattcctccaatgaaaacatgtgagatttaagactttagctatatttcaaaacattacaggaagtttcagtgagtatcccttgtcaattgcttcaaaaactcacatcttgggtcttgtccttggtccagaaaagcaatgcttctttcactgagggttactgaagatatctcatgcatctatttgtgttcttaaaacatgtgaaaaatgtatggctggtccatggatctagaaatatctcctagtgggacaatttccatatttccacacaggctttctattatctcaatctttcagaaaagtataaaggtatccagagcagatgtccaaaatatagacacttaaacataatgctagaactactgtacaaaggtagttaaaattttacatcccctggaaaatttcttcatagaaaaacagagataatttctttgcatgactatataaatattgacctaattagtggaaattaacctggacactcccattatctggtgacccaactaagcaaaccaaaaatttgtcaacaccaaaatttgtttcttgaatttgtaacttctctgtcaataatggtgaagcaaccatgaatattttactgtgattaaggatttataacatttatgtgcccagctatttaactctatagctaagaaggaaatgctgggatttaactgtgaaaaagccaacgacaaagctttcttatgggcagaagcagaactcttgtctttcagtcattcaagtagtatattcctaagaccacttcttttctgattaaaggcatgtctctatatctcccaaatctcattccaggaaattgagagcttctacaaatttttacaaacaaaggtggatgaaataaaacaacccatctagaggactagataccagttgaagacatactgtagcttgggcagaaattttaatgtttaacctatctatctcataggttattctatcaggaaaagaaatcttccatttatatgtgtacacatagtctatgacttttacatcatcaatatttgtaattaaaaagaccataaggcatttatagattaattagaatatttggaacaaattcaaatgaacacttttcttctagagaacaatccctaggggaaaaatacttggttcttgccaaggaaaaagacttggcttttgtcaagaaagagtaactgaatgccaagtaatgtgaaaatcttgtaatgtgaaaaaagaaatgctaaagtaaattgaacaataaattatgttttacattatgaaatactgaggtaaagcaagtaatatttaagccagaatgacgaggaaaccaggcccagattctcttacctaatcacatcctcagcaaggaggacctaaccttgttgatagaaagtctgtgcctaagaagcctgagacttacaggcagagagcctcagaactgaagttgagattctaacacttagaaaaagaggtaatcatagttgtacagttttaggttggagtagaggtttttaatcaaaacctgaatctgtgtcatatgcaaccataatgataattagtccattaattcaatcctctaatgtatcagtccatttttatactactataaagaactgcctgagactgggtaatttataaaggaaagaggtttaattgactcacaattcagcatgtcttcggaggcctcaggaaacttacaattatagccgaaggcaaagggaaagcaaggcaccatcctcacagggcggcaggaaggataagtgctgaacaaagggaaaagagcccctttataaaaccatcagatctcatgaaaactcactatcacgagaacagcatgggggaaactacccccatgattcaattacctccacattttctctccctagacatgtggggattatggggattacaattcaagatgagatttgggtggggacacaaagtctaatcatatcattctaccctgggcccctcccaaatctcatgtccctttcgtcttttaaagagacagttatgccttcctaacagtccctcgaagtcttaattcattccagcattagcccaaactccaagtccaaagtctcatctgaaacaaggcaaaaaatgtacttcaaagcatttaaaaaactaacaaggaacaaagaaggatatggtggcatgtttctctgtcctagctacttggaaggctgaggtcggagtatcacttcagcctaagagtttgagtttagcatgggcaatatagcaagagagaagagaagggaaggtaaaggagaagggaagggagaagggaagggggaatttaagtctttaatccattttaattagatttttgtatttggagaaaaatagagatctggtttcattctcctacatatggacatccagtttccccagcattatttgttgaagaaacttttccccagcatatgtcttttccctagcatatgttcttggcacttttgttgaaaatgagttcactgtaggtgtgtggaagggaagggggaagggggagagggaagggggaaggaagggggaagtggaagagggaagggtgggggaagggaggggaaagggagggggaagggatggggaagagagtggggaggggagggcaggggaggtttaatcaacaccattaacaaatttgaccaatttacataagagaacaatgtgcccaaaagctgcagaatatacattcttttttaaaattttaatttttaatttttgtgggtgcatagtacttctgtatatttatgtggtacattacatgtttggatacaggcatgcaatgcataataatcatatcatgaaaaatggggtatccatcccctgaagcatttaccctttgcattacaaacaatccacttatactcttttagttatttttaaatgtacaattaacatattatcgaccatagtcacccttttgtgctatcaagtagtaagtcttatatactctttctgattatttttctacccattaactatccttatctcccaccctctcacctccccgctacccttcctagcttctagtaaccatccttctattccccacttccctaagttcaattgttttgaattttagatcccacaaataagttagatatcatgatgtttgtctttctttgactggattacttcacataatataatgacctcgggtcttatccatgttgttgcaaatgagtgaatctcattctttttaatggctgaatagtactccattatatataggtaccacattttctttatccatttatctgtcaatggacacataggttgcttccaaattttggctattgtgaatagtgctgaaacaaacatgggaaggccaatatctctttgatatactaacttcctttcttttaggtatacattgagcaaaaggattactggatcatatagttgctcaatttttagttttctgaaaaaccttcaaactgttttctatagtagttgtactaatgtacattcccatgaacagtgtattaggattccctaatattttgctcactttttcattggcttattagattttttttttttagatggagtttcactcttcttgcctaggctggagtgcaatggcacgatctcagcccaccacaacctctgcctcctgggttcaagtgattctcctgtatcagcctcctgtgtagcagggattacagacatgctccaccacacctggataatttttatatttttagtagagatgggttttcaccatgttaaccaagctggtcttgaactcctggcctcaggtgatcctcccacctcggcctcccaaagtgccaggattacaggtgtgagccaccatgcccagccagatgttttcctatagaattgtttgagctccttctacattgtcattattaattctttgtcagatgggcagtttgcaaatatcttcacccattctatgagttgtctcttcactttgttggttgtatcctttgctgtgtggaagctttttaacttgacgtgatcccatttgtccatttttacttgtgcctttctgtgctagggaaatattgctcaagaaatctttgcacagaccaatgtccaagagagtttccccaaccccaatgttatcttgtagtcgtttcatattttgaggtcttacatttaagtatttaatccattttaattagatttttttgtatttagagaaaaatagagatctagtttcattctcctgcatacggacatccagttttcccaacattatttgttgaagaaactgtcttttccccagcatatgttcttggcacctttgttgaaaatgagttcactgtgggtgtgtggatttgtttctgggttctccattctgttccattggtctatgtgtctgtttttaggccagtactgtcccattttgcttactatatctctgtagcataatatgaagtcaggtgacatgattcctccaatttggttctgttgctcaggatagctttggctagtctgcatctttagtgattccatgtaaattttaggttagatttttttctatttttgtgaagaacgtcattggcattttgatagggattgtattcaatctgtaggttgctttgggtagtatggacattttaacaaaattgtttcttccaatccatgaacatcaaatattttcccttttttgtgtgtgtcctcttcagtttccttaatcagtgtttacggttttcattatagagatcttccactttttggattaattaattcctaggtatttaatttaatgtgttgcttttttaaatgggattatttgttctttttcacattgctcactgttggaatatagacattctactgacttttatatgttgatttggtgtcctgaaactatggaatttattatttctaacagtttcgttgtggttattccaaatataagatcatatcatcagcaaacgaagataatttgacttcttcctttccaatttgtattccctttatatctttcttttgtctaattgccctagctaggacttccagtactatgctgaataacagtggggacagtgggcatcttcgtgttccagatctgagaagaaaggttttccatgtttcaccattcactatgagactaactgtggatctcccatatatagcttttattatgttgaggtatgttccttttacccccagctttttcagggcttaatcatgaagggatgttgaattttatcaaatactttttcagcatcagttgaaatgatcatatggtttttacccttcattctgttgatatgatgtatcacactgattgatttacgtatgctgaaatcccagggataaatcccacttggtcatgatgaatgatgtattgctgaattcagtttgctagtattttgttgagggtttttgcttcaatattcatcagagatattggcctgtagttttgtttgttgttgttgttgttgatatatccttgtctgctttcagtatcagggtaatagtggcctcagaataagtttgaaaatattccttactgctctattcttcagaatagtttgagttggattggtattaattcttctttaaatgtttagaagaattcagatgtgaagctatcagctcctgggcttttctttacttcgaggctgctcaggttttggatttcttcctcattcaatcttggtaggttatttgcatctaggaatttgtccatttcttatagattttccaatttatcggtatataattgttcatagtagccactaatgatccttcgaatatatgcagtatcaattttaatgtctcctttttcatttctgattttattcatttggatatttttccttagttactctggttaagttctatcaattttgtttaactttaaaaaaaaaccttttgtttcattgatattttgtatttttatttatttatttctgctgtgatccttatcgtttcttttcctctagtttttggctttgtttcctcttgcttttctactcctttaagatgctttgttcgcttgtttatttgaaggggtttttttggtgtaagcacttatagctataaacttccatctgagtaatgctttctctgtatttgatagattttggtatatttgtttccattgtttgtttcaagaaatttatcagttttcttcttttttttaagtcagtataatttatttttataataatctacattcacgagaatgcagtaagattctgcactgatatattgctgctgagaggtaattgatataaatctagaaaaccatttgaaagtaggaactgtctttcaaatgcccctccctttaaaaagacaaaggaaataccataaaattaatttcttcatggaccccactgatcattcaggagcattttgtttaatttccatgtactagtatcgtttacaaaatttctcgttattaatttctagttttatttccttgttgtcagagaagataattgatattatttcaaattttttgaatgtttttggacttgttttgtaacctaacatatggtctatccttgagaatgatttgtgtgctaaggaaaagaaaatgtttcctacagccactggatgaaatgttctgtaaatacttattatatccatttagtctttattgcagattaagtctgaagtttctttgataatattctatccgaaagaccttggatacaaaaaaaattgataaattgaacttcatcaaaataaaaactttggctcataaaaactgttaataatatgaaaaagtgagccatgcattgtgggtatgcttacaatacatatgtctgaataagaacttgtatctagaatgtattaagaagttttacaagtcaagacaagccacatgatttttttaatgttcaacagactagccaagaattatatgctcaatatctttagtcatccaggaaatgcaaattaaaaccaatccaattgttactgatgatgcggaataactggaactctcatatgtcccttgtggaagtatataattttacaactgtgttgaaaagctttttgactgttataaaatttagtctttacccttcctcctaactagcatatatctacaatactacaacccatgtgtcttggataaagacatgttaatggcccaaaataaatccctgtatgggcagatataaacacacgtgtggtccagtgcagctcagtgtatggcaagatatagccccatgtgtagacagacacagaactgggtgatatcatatgcaaaacttatataaatgcaatcataaaagtaatcaaatactgatctttgtgttttcacatacagacctgtgtgttcatatatagactttgtgttcagttagatacagacccaaaagtatcactggatacacacctatatatggtcatacagacatatatgctgctggatacagatacgagtgcacagtcaaatacagactcctatataatgacattcaaacctgtatatagtcagatacaagtctatgtgtgtctgaatacagacctatgcccatggctttaaagactgtgccaggaaatgccaggaaaagatgctgagtcctctcttgtcaggtcattgaaaatattaatcaaatgtaaataagagaattccctttttaaatgaaaaagtcaaaaagcaaggtatacatagactatgaagatgtttacaactttttttaatctttaagttcagtggtacatgtgaaggtttgttatggggatgtcatggaggtgtgtcattttagaagtctgacatagggagtcgttgtatggattatttcctcacctaggtattaagcctagtacccatcagtatttctgtgatcctctcacacctcccaccctccatcgtgtctgttgttcctctctatgtgttcgtgtgttctcatcatttagctcccacttagaagtgagaccatgtggtgtttggttttctgttcctgtgctaatttgctaaggataatggcctctggctccatccatgtttctgcaaaggacatggtcttattcttttttatggctgaatagtattccatgctgtgtatgtaccacattttctttatccaatctaccaatgatgggcctttatgttgattttgtgtctttgcaattaatagtgttgcaatgggcatgtgcatgcatgtgtctttatgttagaatgctttatatttttttgggtatataaccagtaatggggttgctggctcaaatagtagctccatttttaggtctttgaggaatcgccacatggttttccacaacggttgaactaatttacacaccaatcaacactgtgtaagcattcctttttctctgcaacctccccagcacctgtaatttttttactttttaataatagccattctgactggtgtgagatagtatctcactgtggttttgatttgcatttctctaatgatcactaatattgaccttttttcatatgcttgttgacagcatgtatgtcttgttttgaaaagtgtctgtgcatgtcctttgtccactttttgattgagatttattgatcaagacttcacaataagtgtcttattctaggtaggaaaatgagatattataatacaccattttgctcaaaataaacaagtaaggtcatgaaaccctaaatataattttatgaaaagtattcaagctttacaaaacagtcctaaggtttattaggaaaaataaatatttagaaattgcaagaaagctgaaaaagattagtaattaggggagactatctctatttaaatatttaaaatccttgaccactgggatagtgtgttggtgaaaaaaaaaaccaaaaaacaagaaaagaagaaacagaagaagtgtcctgagattgaaccttctagatgtaaagaatttgacatactaaaaggataaattccaaattgctattgaaaataattaatggattagattggcaggttattttacctgtttaggaaaactagacttcaatattttcttatgataaagaaaaataaattttccattggctggaaaacaaatgtttttgtaaagtgatttttttaatggggacgactggaggcaggagagggggagatgggcaagggctcaaaaactacctgctgggtaccatgctcactacctgggcgtgggtgcaatcatacttcaaacctcagcatcatgcaacatacctttgtaacaaacctgcacatgtgcctcctgattctaaaacaaaatctgaaaagaaaaataaataaataaaataaggtgttaaaaagtgtaaagtcactagagggaaatggaatttactgaggtgtgatgtgaccgaaaaaaataagaagtaaaaaagttaaggtaaaacatttctatataaaaacatccataattgtagcatcaataacatagtaaggtaaatatttatagcaaatatcaaagaatggtatgaacatatatgcatctttgatacggaaaaattttatcagaatgtatcagtaaaaattctacctccaatagattaagaactcaaggaaacaagtaattaacaaagtttatggagtgggctctatgtgtcatacattgtgcaaggaacagagagcacaaagagaagtaactttccctgacttcggggaactttcagaccaataaacataaacagacaattaaccaagatttttttatttcatcacttaatagaaccatacaaattagaaaattaattacatgtccaaaaatgcaggacctagttatataaactctgatactaccaaatgctcaatactatttggagaatggtgctatgttttggaagagcttggattatgtaagaaatctccatgtaataataataaggataaaaataataatacaaagtgaactcacatagtgtgatttaccagggaaattgacatgtttttccctagccttagtccctcatgaatccagagtacagaggagaagcaggaacaatgagtttctttgattacatgttttctacctgtagtcaggggcagataaaattttatttcaagcctgattcaaaaggaattttcacacagatttttatgaattaagtgtctttccaacgaaacaatatgttttagtcctttttttacctaataatctgcattctatcaataaagtaagaatggaagcatcatatattgccagcatctttttttctttttctttcttttttttttctcagcgttgctctgtcacccacgttagagtgcagtagcgtgatcatggttcactgcagtcttgacctcctgggctcaaaaaatcgtccaacctcagcctcctgagcagctggaaccactgacatgcaccaccacaactgtctatcttccttgaaaatggtgtattccaaaatatttactatctggctctgcattccatatttgaagttcatagattatggattacgctaattttacatatgaaaagcagagcctggctgttttttagaaggccatgagaagggggtattgaaaatagcagagatattatcagatattctaaacatctgggaagatcaatggatcatttttacataaatatagcaccaaatcaagctgcttcacctgaggacttaatatgatttctcaattggagaaaaaagtaagatttagttatttttctgcatgtctccctttttcattcagattcttttagtatactgtctccttatgtataatactgaaggaagcactattcctcttcaaccttaatatgctagcaatatgaacaaaattatatataaatagtatcttacaaatacaaaataaaatatatacttcaaatattaatgtggtctgtatttgtgtggggaggagtaaatgaaatttttatgtcttatttcttaattcattcttctgaaatctgtaatgagcactattaattccaaaaagggattaactttatttaaaagaaaaacatgagaaaaactttcataaacttaaataaatttatagtattaataacataaatttatcatctcgagagccattctacaaacaaaaagtgaacatatatttttccaataaattattaaaattttctaaatatattttgattattgcaagtattcatgtaataaatgattttcactgcatactagttattaaacctgaggaaaatttcactgccattaaataatcacaaatggctttcctggagggagcaactcttcactgaaaatagatgatacatttgtctgccacctcattttctttttctagtccagagcttcttcatagcatttttcatctctgcatttcttaaagtatagattagagggttcaacataggtgtgataacagtgtaaaacacagtcaaggatttatcaatgggtaaggtcaaaggaggtctcacatacatgaaaatacaagggacaaagaagaggatcaccacagtgatatgggagccacaggtggataaggctttgtgcctcccttcctgactaagattcttcagggagtgcagaatgaccccataggagaagagtaagagcataaagatgaccacacagattgccccatcattggcaaccacagtgaggccagtaacataggtgtcagtgcaggcaagttttaataaagggtacatgtcacagatgaaatggtcaatgacattggggccacagaagggaaggttgtaaacaaaaagaagttgaactacagcatgcaagaaacctccagcccaggccaacagcagcagtagaatgcacacccgttggttcatgatggtcaaataatgcaggggtttgcagatggtcacgtagccatcataggccatgacaacaaggagtaaaatctcagcacccccaaataggtgtcctataaaaatctgggtaatcaagcttggaacgaaatggttttcttctcatagagtaagtctataatcatatttggggtaactgtagtagaatgaacagcatccataaatgataagtagccaaggaagaagtacatggggcatccaaagttgggctgaccaccacagtcacaacaatgaatatgttgcctaccattgtcacaacgtagatgagcaagaacacaagaaataatattttctgtccctgggggctctgagtgagccccacaaggacaaactcagtcacatttttcctttgctccatatgcctttctgtatgtccttattccagttgaacacaggacaaaattacttaaaaatataattgttactagtagcttcattaaattttaggataatttgtttattcattcaacaaataggtgttatgagttattatgttccagaattgcaagacattataaaaatataaggctgattaaagcatggtccccaacctcagcaatcttacaaattaattgagagagaaataagtaatttgggatgtatatgggaaaaggacagtttattaaataaaagagtttgccaaaactagttttacatctggaagatcataaaattatacatatagctaataccataaacaaaaataaatacaaatgaattaaagatttaatataaaactaaagctagattttctttatatttactttccagttaataaaggagatgactttctacattctctggatgggagaatcttaaaaattgaaatccaaaataaacatatttgacaatttcaaaattgtttaagaatttgggaaaataataccatttaaaaatatttataattttgagggcacagagttaatatttaaaatagaaagagtgctctaagcaattaataaataagagacaaaccaatagcaaactgggcaaatgatagaaaccagcaatttaaaaagaaacagtacattaacgtggccaaatataatagtgtgctgaagttcacctataaatagaaaaatacaaaatataaaacaaatatcaccttatattcatgaaactgacaaaaacgttttaaaagtgatagtagctatagctagcaaaaataaaaaagggtattttcttgcactgatagggaaaatatggattttataatatttttggaacaaaagttagcaatctctaatgaaagtaacaatatctttcaacacaactgctcccttcaaaagctaccccatagaaattagagccctagaacataaggacagatgcatggcatgtttttgtgacattatttataatggcactaaacaaacaaaaaatatggaatacagatatttaaaacaattaattgcagccatttcagtataataatatgattcagcaaacaaaataaaaatactatacatgtatccatttataagtgtttgcatatgactatatgagcatgggaaaataacgaaggatatatgttttttgttgtaagcagggtttacatttgcattggtgatgtgggggagaggagagaagttgtgtgtgaaagaataaaactaacgaagaggagaggaaggaaggaaagaaggaaggaagatggaggaagatggaataaaagagggagggaaagaaataggggagaaggaagggagggagggagggaagagagagttagaggaaaagaaggcttcacacacacacacacacacaaaactatatcatacgtagtgacaatattcactagcccagctatctcctaaaataatcctactaatgacaactaatcgctaagtctctgttgacattacttcaatctaacctgataaataatgtcccatctgtttttcaaatacacagattgtctgtgttgctaacaatggccaacctctctagaggttgcactagattccgtgctctttaccactcttaagaacagtgttccttcaattttctccatttcgaatgtcaacaattttcctccctatattgcatccttcttccagcatatttgtatgatctatccccacgtttaaaaatatatttatacccctggacagcatatctctttcaagcaaccaccccatcttgattctctgttattctttctaaataacactttcactttactaaatcaagtggtcaatttcaatactcttcttacttgacctatcattcctatgaattgaagtaacaccttgcttactttagtcttaccttgggttcttgaaagtcactcattccacttctacagatgctatatcatctaatttttggcatattaatcaatgcatagagaacacactgcttgatcctataaagagatttacaaatacctgcccattaaaatatcccccaaatggttacatttgaaattagtttctaagaacactgatgtagagaaagtaaattttttctgttatttaatgttgaaatatccaaaaaagtattacagaattgagtcaattcacataaagtttagcaatcatgaagatccactaatgtggtttattatcagaatcacttagagaactattaaaagacagaattcccacatcatcagtgttactgcataatgtaaagcctagtgcagaatctcacacataaataccttcctgggtatctgcataagaagacagtaattcattccgggttctgatgatggtaccttccctcttgtcctaaaaaaataacagctgtgtacactgacaccatctgtgtgaacacagagagtaaaacaacacatgaatcatcactggaccttgaaatgcttccatgtgatcaacgttttccatgcttgttgaaagtttgatttatatcagtctttcagggggaaaaaaggttaccttttaacttattgagattttcaaaatgaatatcaagaatgttctgtaacctaaagaagcctcaatcttgattgtgaactgagacccaaaatcttcactgttggcaaaatttgtcctaataacaaacacatgttatataaatacttttttattttttattttaatggatacattataattgtatatatttatggggtatacatgatattttgacaaaagcacacaacatgtaatgatcatatctgggtaattgggatatccatcacctcaaacatttatcatttctttatgttgagaaaattctaaactttctcttctagctgttttgaaatacagtcaactataaactatagttgccctatcatgatcatattcttcctacctaactgtatttctgtatatattaatcatcaactcctcttcatctgctctcctcactagccttcccatcctccggtaaccaccattctattcactaccatcatgaggtcaattttttatctcccacatgagtgaacacctgcaatatttgcctttctgtgcctgcctcattttatttaatataatatcctctggttccatccacattgctgcaaatggcagaattttatcctttttattacattatctcaccccagttaaaatggctattataaaaataacagaaaataaatgctgatgaggatgtagagaaaggggaatgatcataatctgttggtaggaatgtaaattaatacagccactatggaaaacagtatggaggttcctcagaaaattaaaaatagaactaccatatatctatcaatcccattggtagttatacatccaaaagaaatgaaatcggtatatcaaagagatagctacattccaataatttgtggagcactattcacaatagccaagatatggaatcaacccaagtgttcatcaaaagatgaataggttaaataagcatttcgaagttaagaaaaaacttgaatctgtgggagagagaattgtgactttttactataaatatttgtatttataccaataaaagtaaaataatgaaatagcctttacaacacattgatcttcaatcagttatatgaacctgtattcatgccacatagttgaaccttgggtaatatgaaggatggagaataattttcatccttattttatcatgtttgagtctgtcattttaattcctaaacaatcagtcatgtgaatactgctataaacaaatactcttcaaaataagggcagaagtctgtggatactttatccacatttgaactgcagcacatattgttgagtcattcaactggtgcatctccaaaggtgattcttctctaattaaattcattgggacctttatcataattctgagggtaggctctgtatctccggagatgccacagggataataactatgtataacaagatttatagaatcatgtcctctagggaaaaaattacaaaaggataccaaagtcaaatcaccaaaaggaaacagtccagtctgaatataaacgaaatatataaaacctagtatttaagtcatgacctgcaaaatagacaaatctgttgagtgtatagtcacagacaagcttcattaaggggtccatgtcacagacaaaacgaccaatgacattggggtcataagatgggagcccatgaataaggccaagttgaattactgtgtgcaaaaatcctccagcccagggcaccaccagcagcacaacacacagccattgcttcatgacaaccaaatactgcaaggactttcagatggccctatagttgtctaggccatcagcaacagaaggaagacctgagatctaccaagaaaaaaaaatgtgctttgaagagctgggtactgggtcatacaacattggaaagagaattgcatgtttgagtacgaagtggttgtgcatagtcttatagtccatgaaaaggccaattagttttagagtaaatttcattaatcagataccttactttataccagtcaatttatctcagcatttctaagtgactgcaagacctttcatgtgggaaaaaaaatggtaaaaattaaaataaaaggagaacatgcagagacaaagtggagatcaatgctgttgaatacatcagaaagttcaccaactgccaggaggcacgcacaaggtgttttgaaaaaagatgatagcttaaatatgtatgtttaattttgtatcatccttattttaattacagctgaattaattatagtaggttaaggttgctaaaatatgtgtgtgtgtttatgtatcatgtttattttatttttaataaaatgtgtagtttttaatcaaggagagatgttattgatactcatccaggtcagataaaattcccctttccacaaacagaaactcctctccagtgagtttacttattcatatcctttcagtttattgtctcttatctctggaagtggttatgtaaacagttaatacgtgctcttgggtctcctttgaacactcgtagccccctacctgttgagtagctctctatcacatcatttgtttcactttttacacatttccactctgttatattttatctttttatgtgcatgcttacttgtttattgtctctctccccctgtaacagaaaatgttccttgggatgggcataacggctcacacccgtaatcccagtccctcctgcaggaacactgaatttcaacaactaattgcacacacacaaaagcgcaagcataacaacagaaaaccgggtgagcaatccaagtacctggttttaacttcacatcattgaatgaaacatacttaagagggtaggaaagacagtctcaaatcaccaataacacccctcctaaattccacagcagtggctgcatggtgcaaagagataatctgtgcacttgaggaaaaaaagagtatagacatggggtttggcattgaactcagtactaccttgtcacagcagagagcaaagccatgctgagctcaactgtcacccacccatggagactgcatttggaccagctctagacagaggggaatcactcatcacagaagtcaaaactagaatttcttggcaagtctcaccactgtgggctaaagtgctctgggctcttaggtaaacttcaaaggcagcctaggacacaaggcctgcaattcctaggcaagtcctagtgctgggttggacttagagccagtgcaataggggagcacatgacctatggagacaccagccagggctgccaaggaagtgcttgtgccacccctcccctgaccccaggcagtgcagcttgcagcaacaaaagtgactccttccttctgcttgaggagaggagagtgaattgtgaagagtaaagagggctttgtcttgcatcctggatgcaactaactgaccacagtaggataggggactgggaagagttatgaagcccacatcctaggccctagctcccttctatgtgaagtagcaagcttctgtacatagataaaatcacacacatatatttacatttgaagattattacctgaaacatcttaagaaacagataatagtgacttcctctgatgaagagaactaggagactgcactcagatatggacaagagatttatttctcattttatattattttgtacagtttccatttttgctatttatgattatccatttggctttcaatttttcttttaaaaggtagaaatattacattaaaaatctgtatacagtacaagttcaattggatgaaaaggactgcattgatataaattataccattaactattttaaatagtataagaagaagaatgaacttaaaggacaagaatctaactaaaaatgaaattaagtctcagaaagaaaggcaaaaacatacaggaataacttgattaaaaatcattgtaactctaaaatttcttaactaattcactacatattattgactccttgttttatgcattacgtctttacagataaaatggaaaacaagacattacagatcttacattctagcagagaggtagactgttactattaacacaatcatattgttcattctttaataataattgtaaatgctttgaagaaagggaatatggcatcagattttaaaaaactcctgggtcccaaggagagggctgtaaagtcaaatggctctcttcctggtgggtaactcacttatgtactacttgatatgaggtctctgctctaaagcttcttcatagcacttgtcatctcagaatttctcagagtgtagattaaggggttcagcattggggttatgactgtataaaacacactcactgatttgtcaatggagaaggtcctagcaggtctagcacacataaaaatacaaggaacaaagaagaagacaaccacagtgatgtgggaactgcaggttgagtgggctttttgcctccctttctgactaagtttctttagagagtgcaggatgacaccataagagatgagtaagagcagaaacgcaatagtgcaagacagtcctccattggccaccactaagaggccaataacatgggtgtcagtgcaggccagtttcaataagggatacatgtcacagaaaaaatgatcaatgacattggggccacagaatgggagcccataaataatgctaagttgaaatactgattgcagaaatcctccaacccaggacactaccagcagcaaaacacacacccattgtctcatgataaccaaataatgcaagggcttacagatggccacatagcggtcataggccatcaccaacaggagaaagacctctgacccaccaaaaaggtgctcgataaagagctgggccatgaaagattggaaggatatggaattattcccaaagaacaagtctgaaatcaatctgggggaaatggatgaagaataaatgatatctataaatgttaagccagcaagaaagaaggacattggtgagcccagggtctcactgacagttacggtcactacaatgagcaggttgcccaccatggtcaaaatgtagaagagcaagaacataacaaaaagtactttctgctcctttggattctgtgtgaagcccaagaggacaaagtcagtcacatttttccttggctccatctattctttacagctgcttacttcagatcatataagcagtttacctataaaacaaggggggaaaactttaaatacattatgattttaatattgtatttactcattcaattaaaaatgtgtatgcagtatctatgtcaaatctgtcatagactttggaattgccaagttgaaaaagacacaattttgtactctcagtgatttggtaaataaaataccaaagggaataaattaaataccaattaaataggtgtcataataaatatattgacattattgtaagggttcacagtgctaaaacactaaatcaaactaggatcaggaaagacttttcagaggaagcaatgtcttagctgagatataaaggaaaggtgataattaactagaagagaggatgggaagggaattccacataaaggtgcatcctgtataaattcacagatgtataatactcgagaaaccacttaaggtaactaacttacattttcaaactgggaagagctaattatgaatggatctttgtatgtgactaccaactgacatgttcaattgatatcaatttttaattttccagattaacccatttcttccttattttcatttcattaaatgttactacctaccacactgtttaaactaaaaattttacaatctatttcacttctctatttctttaatattatttatcaatatatttttctcaaaccctgttaactcttccttcaaaatatcccaattggatccttctcactaccatcttgttaccccctggcctactctaatagccccctgcaaaatctctccactcatcttctggcctctaataatgttctttcatgaagtagcccaaatgatcttttgaaaatcttattaatatcataccactcctctactcaaaaaccccatggtggatttatattctgcactcaatgaaatggaatctttctaccttggcctacaagaccctagatgacctggatccaggctacctccccaaatccatcccttacaattgtccacatttatactgctccagacagtttcgatattcaccaaatatacaatgtgcttttccatatccttaatttaatctattttttgtagacacttatttcagagattagaagccacttacttctaaaataatggtcaatattgtggaaatgtgtattgtaagtgtaatcttttatttattcattcaattgaaaaatgtttatatgacacctacattgtgttatgcctctcaaataaagtagactcccagccatcacagaatgttcacaaactcattcagggttagggtttagaccaaaagtgattatcagaggagaaatattagtgctaaccaaggaatcatcttttcaccattagtcacctacttttccaaacagaattatacctcctgaggtgaaaagatacataataactctattttaatctattaatgataaatagtatataaatactggccaacagctttctaaattttcttctcaatgatactgaactttccctgaggaagtctccattgagctagttgacttatttctaatcaacagccttattttagatgctgtgaaaaccaaaagccttatttactgggcttttacataaaccatatgtttaatatgcatgtagaaaatgcttcatttttctcaaagtgtctataacactctggttttagaaaataatttagatagaaagtgatagatgatgatgaagaagatagataatagatagacaaccattttatgagaaatatctaaaccagtaaataaatttttctaacacttgctgtaagatatcaaatgctaatcagtactctgtgtcatattttgtaaatgaaatcatcatataagtttattgagtttttttgagtacctaatgacttaataaaaaaaatatgggagcatatgtagtaccatgcttgtatcaatacggataaagtatctggaagtctttgctgagaatctttttgtgctgctgagattattccactgatgtggatggtccatggctgttatgtgaccgtctgtactacatgaccatcgtgaatcaatataggtgtagccatctcactggaatggcatgtactgaaagctttatccaggcacagtttagatcctctccccagtctgacttcctttctatgaccccaatgtcatagctcattcatgtgtgacttaaacacttttttgaaactcctctgcatgggtactactaatacaattggtttctttgttgctgccaatggtgggttcaactacctgttaaacatcattttcttgatggtttcttaagtggccatcctatgtactttgaaaactcacagcttggaggaaagatgctaaagttctctacctgcatctctcacaccaccatggtcatcttatctttgagttctgtatatctgtgtatctgtgcccagtgacccttccccaatcaataaagcaatggctgtgtttcataccgtgataaatcctatgttaaaacctttagtctaaccctcagaaatgcagaggtgaaaagtgctttgagaaaggtctgggtcaaaagatgacctgaagagagaaataatctaaacataagatgattttaccctttcaatggtgaagagaaaataatataatatctaagactaagcgccaagtaaatatcatatgtcagagatgattctggcatataagccatttgagctaaagtccatatagaaaactatttatcattacaaaaataccctttagatttatttattgccaattttgttgttaatcttcagtgtactgtcacaattgcacaataaagtggtcagacaaaaaccaatttagcaagtgtgattataaataatttacattgtgctatggcttcacagccttggaacttctaaccccaactgtgctctgggtagatttctcagtggaagtgataccttaatgagtttaaagaagtgagagaaaaggatggaaaagggaattccatgaaaagatgtgccatgtataaactcactgaagtatcacactgaagatgcacttaatagatatatattcatagtgggtagaatgcattttgtgtgcaaggctatagaccaaatttctttgtattatttactagggctgccaccttataccaatgacgcttttcctccactttccaataacatgttcctcatttccatttttgaccttaactacaaggaccttgacattcaaatttctagaaacatttagttcatgatgaaatatgtattctctaagataatagatgttttctcctcagctcccctctttcatttctgagccttcaccagaatcactgttcaatgtccatattcctacccacagtaacttgaaggatatccaagctctttctataatgcaccctcaaactctgcaggtatctacccattacccagttgcaaagccacttccacatttgaggtattcattgcagcagtaccccactcccagaactgaaagctgtattattttgctagaacaggtacaataaagtagcacaaactgagtgccttaaacgacagaaatttattgtctcatagttctagatcttagaaattcaaaattaacttattaacagtgttggttcctatggaagactataagggaaggagatgttccaagcctctgcccttggcttataaatgaccaactataggttcctacagaatactctttgtatacatgtctgtatccaaattttcccatctattaaggacatcagtcatactggattagggtccacctcaatcatcttattttaacttgcatacctctgcaaagactcacctcaaataaggttatattctcaagtactaagagttagggccccaaaatatgaatttgtggggggtacataatgaaacaataattgtcatacaacacaatgtatggtccataactctcacagtaccagatatcttaccgacccactgaaactttcttcttagtgtctttacttgaatattgctcgttttcctaacttgtaaattctgaagcactctaaaattgtatgtctttactccatttctcccctaattttcaaactcatatctgcagctatctaattgatgcctccaaatagacttcaatttacgatttataaaagcaaacttttaatttttcataatatatctattcctacctaggtttttttaatcaaattaataaaatggtactcccttttgtgttattgttcagaccaaattttatcagtgtccttcaccctttattctactcacattgtttatttctatacttaataagtcctgttcactcttcctctataatatattacaaacctgatcattgtcactacaccccattcattcctggtctactacaatagccaggtctacctactttcctttcggcatttgacaatctgtgtttctgaagtagcccaaatgatctttttttgttcttatattattcagatcctattactcctttgatctcaacccctacaagatattcctattatatgcttaataaaatccaatatccctaccttggcctgtatactcaataaagtccaatatccctaccttggcctacaagatcttagatgactgggatctaggaaacctattcagctaatttcctgcaattctctatgtttacctgctcaaggtttttaccactcctcaaatattcaaactggttttgcatctttttagttctatctattcttttgcagatgccaatcttagtaatcataagcagtttacctctaaattaatgctaaatattgtagaaaggtgtattataagttcagtctttcatttattctttcaaccaccaagtgtcgattgaacacatacattgggtcacaccaatcaaataagatagactcccaggcatcaccgagcatctactactcaattcatctcaggatctatacaaggggtcattttatcagagaaccaaagtcttgatgctgtccgagaaatcacgttttcaccatgagtctcctacttccctaggtggaggtataactttttaggatatatcatggttgctgacttaacttttgtattttttaaatatactcatgacaagtatcatataaaacctaaccagcaactttgcaccagcaaaagtttttcaacatttcaattcttacaaaatcaaatgatataatttcctatgtagtaaaaaattcacacatctgcaaagcttggtttcactaccacctgttaaaatcttacctttgggaagcttatttatgatttgaaaaacactttacctcactcacaaagagctggaagtctctcttcaatccaatatgcacacagaagacaaaaagctgtatcattccttgatgatatatttgaaatcatatggccacgtctgtccattgtcttcagagtttctaagtatttcagaaaattatgacttgcactgtagaactattttaaagaaattccatggtgcaaacagaaaaactaaaacttttcatgttaggataatttattaaaaatacaaacaaatcctatgtctacataagaagatagtaactagcctttttgagagggaaatttttctctcataacttattttctagtaatttcaataaagaataactgccattccaacgtttagcccatctcactctcttgtcttcttatggccaagtattcaagcttgaaatttgcagaggaaattcttgtccgttttttatatcatgtggtaagcctaataaaacatcttctgaaataattagcccttaaaaggatagtatcttctacctgacagaggcaaatattattgaaaagtttgtaccttataagcacattaatcatggagtcctggaactggattctgtctaagactgacttttgcttaattaagttcacagagattttccacatatttttccagaacatttgcatgtagagatattgtcagatcaatcacataactagggtcagaaagatgtaacaagggagaaaaaaacaaccattatagtaggattgccaatcaagaataaaatatcagcccagccacttctcgctaagaagatgaatttatcacattttccccactttgcaatagcagcttttttccttttatctaattctccattttttctgcctacaagtgtaggtttggatatgtttttaaaatattttatttagttgttataactatttatctatgtatttattattctaaaaaattgttatgagcatctttttcatgccaagttctatgccataagcttaagatacaatagttaatgaaacagaaaaaaaaaaaacagcataaaagtcctgcctacattaactttatatcttctaagaaagtcaggagaacaatttaataaattacaatctgtgatcagtatttaaaatactgagtattgtgatgaaaaataagagtgagatattactgtaaagaaggtaaccagaggttttttttaaatggtgatacttagccgaggtccgaaggatgaaacattgctccacggaaagtattgttacatgtggaaagctccaatatttaaagagctgagcaagtgcaagtcaacggaacgtcttagtacctgaaaggaaatggaaaagagaaaggacagaacaaactgaggttgaagagatggacagaagccaagcccttcagggcagtatagatcttggtaaggaatttatgtttcatttaaagttctttttaaagaaaagtaaaggggacttctaatctagcatgtaaagagcttagaagtcaccactgtaccctaacaacaagaaaaaagctgaacaaactaaaataccaacaattcatcttaaatccatcaaagaagtgagctcacaacgcaaattgctgccctcaaaattgcagagatagacaggcagatagagagaatcacaccttccctgagcagaaacccacaagcagaaaccccacaggagccagtgccaaggagggtagatgtaggtcggaaaaccctgaacttaattgatgtacttcttaatgtggagaagcctgaaagagacacctgaaagataaaaactctaggggagccagtcaaggtgggacagggcagggggtctctcacacttttgtgagttttaacttcatgatccctacctgacactcacagaagatgttagaaaaagtcctgtctgtacgttaaacaaaatttttaaaaaatatatccaaacccacactaatgggaaaaaaaatcaagtattagataaaaagaaaataattgctgtggcaaagtagggaaataagtgataaattcatcttcctggagatgtggaaaaacatttttaaatatccacagtattctgttcttcttaacaaggcctgccctcagaagaacctattgttaacttgctggaattttattacagcctaacctattttaagtaaatgaaatacccaatcatagccttctctaagggcctcttataatggcactaatcccatttatcagggctctaccctgatggcctagtctcctctcagaggctccacctcctaacaccattacatagggggttagaattttaatacatgaatttcagggtgacacaaacatcaagtccatagcaccttcaaaaacagaaattaccaggtcagacaggttcactggtaaattctaccaactatttaaggattatattataccagttctctaaatttcttttagaaaatagaagaggaaagacttcctaactcattcaatgaagccagccataccctattcccaagaacgaagacattacaacaaaagaatacttcagactgatatctctttttaacatatatgcaaaaatcctcaacaaaatattagcagattaaattcaacaatataaagataattgtacaccaggatcaactgagatttagaccaggtatttttgaatgttgattccaccctgcatacctggactaaatctcagtagatcctggtgtacaatttagtccaggtatgcagggtgagatcaacattcaaaaatcaattaacataatccattgtgtgaaatgttaaagggaaaaaatcaaattaccatattaatagatgcagaaaaagcatttaaaaaaatctaacacctatttatgattctaaaaaaaaatctgtaaagtaagaatctacagcccgcatcacacttaatggtgagaaacttgaagctttcctactaagactaggaaaaaggcaagaatgtctcttctcatcacttcttgtcaacattgtcctggaagtcctagctaatgtaataagacaagaaaaagaataagaagtatactgataggaagaaataaaactgtcaatgtctgtagatgacatgatcatgtttgtagaaatttttttaaaatcaacaaaaaactggaattaataattagagcatagtggcaggatcaaggttaatgtacaaaagtcaatcacttttctatataccatcaatgaacaagtataatctaaaattcaaaacaaaatatcatttactttagcattccaaaaaaatgaaatacttaggtataaatctaacaaaatgtgtacaagtgagaaaaactacaaagctctaattaacaaatcaaggcagggtgcagtggctcaggccgttaatcccagcactttggaaggctgagacaggcagatcacctgaggtcaggagttcgagaccagccttaccaacatgcagaaaccccgtctctactaagaaaaaatacaaaattagccaggcgtggtggcacatgcctgtaatcccagctactcgggaggctgaggcagcagaatcacttcaacctgggaggtgcaggttgtggtgagctgagatcacgccattgcactccagcctggacaacaagagtgaaactccgtctcaaaacaaaaaaaaaaaaaatgaaaaaggagaaacaaataaaaaaactaaataaatgaagaaatatttcatattcatggataggaagactcaatattgtcaagatgtctattcttcccaacttaatctatgcattcattttaatcccagtcaaaattccagcagagtattttgtaaatattgacaaactaattctaaagcttatatggaaaggcaaaagaccaagaatagctaatgtgatactgagggaaagaacaaagttggagaactgatactacccaaattcaagacttgctatagaggtacagcaatcaagacaatgtagcattggtgaagaaatagacagatcatacaacagagaaatgatatcagatactttggaagacagtttggcaatttcttatgaaactaaacatactgttatcatacaatcaagcaaatgggatttttgatatttactcaagatgaaaatttatgctcacacaaaaactcacacacaaatgtttctagcagctttattcataattgccaaaacttagaggccatgaagatgctctttattaggtaagtggataaacaaatgtgtgcatccagactatgaaatattattcagtactaaaaagaaatgaactaccaagccatgaaaacacatgaagaaaacaaaatacatattactgagtgaaaatgcctatttgaaaaggttatatattgtatatttccaactatatggcattctggaaaaggctaaactatggagacagcaaaaatatcagtggacattagggtttatggaagaaggagggataaataagtggagcacagaggctttttatttttagttttactttaagttctgggatacatgtgcagaacatgcaggtttgttacataggtatacacttgctatggtgttttgctgcacccatcaacccatcatctaggttttaagccccatatgcattaggtatttgtcctaatgctctcccttcccttgccacccatggcctgaaaggccccagtgtgtgatgttcccctccttgggttcctgttttctcattgttcaactctctcttatgagtgagaacatgtggtgtttggttttctgttcctgtgttagtttgctcagaatgatggcttccagtttcatccatgtccctgaaaaggacatgaaatcgtgcttttttatggatgcttagtattccatggtgtatatgtgccacattttctttatccagtctatcattgatgggcatttgggttggttccaactcttgagcacagaggatttttatgtcagttactctattctacatgatactgtaacagtagatacatgacattacatatttgtccaagctcatagaacatacaataccaagagcaaatcctagtgtaaactaagaactttgagttagataggtgtatcaatagaggtttattgttgtaaaattgtaccactgtggtgtgtggaatgttgatagtagaggatactatgcatgtgtaggtacagaggttatataggatttctttgtactacctgctcaaattccatgacactaaaaaataaaatatgtgtttaaaacaacaacaacctgacaagcaatcagggaaaggaagctcatacgtgccagaggataagtgattctggagcccacatttggagcaaaggtccagatagagagatgagacaatatgaaatgattttaccattttggacataggtgactatggattttaaacaggaatttaagttggagacagattatcagagttagccttcttacttacaaagttataactttaaaaagttattttgaacatctacaagtctcattgtttccctaaaacaaagagaataacatgtaattcatgacattatgatgacaatatgatataaggcgtgtaaagtgcttattcagtgcctaatacacaatagtgaacaatataatttttgatttatttaaaaaacaatgagagtactaattaggttcaacctagctttccttctgaaatcagagattgggtttcttcaggatggtaggccacagacaaatgaaccacacgttcatggatagagaaaaatcaatattattaaaatgtccataccatccaaagtgatatacaaattcaatgtaacctgtaccattgtaatcatgtaaaaattccagtgacttttttaaagtttagacttttttaataaatacataaaattcaaatggaaccacagaagacttcaagtagacaaagcaatctttaggggaaaaaaagttggaggcatcaaatttcctgattaaaaattatgtgacaaagtggttgggcgtggtagctcacacctataatcccagcactttggaagtctgaggcaggtgcatcacttgagaccaagagtttgagaccagactggctagtatggtaaaacctcttctctactaaaaatacaaaaattagccaggtgtggtggtgcacatctgtaatcctagctacttgggaggctgagacacgagaatctcttgaacctgggaggtgcaggctgcagtcagccatgattacgtcactgcactccagcctaggtgacagagcaagactctgtttcaaagaaaataaaataaaataaattaaaaataaaaattatgtcacaaagctattatcatcaaatcagtatggttataaaaacagtatggacataaaaacagacacatagaccaaaggaacagcatagaaagccaagaaataagcccatgcatatacatttttcttcttttttttttaagacagagtctcgctgtgtcacccaggctggagtgcagtgggcaatctcagctcactgcaacctccacctcccaggttcaagcaattctccagcctcagcctcccgagtagctgggattacagttgcccacgaccatacctagctaatttttgtatttttagtagagacgggggtttcaccatgttggccaggctggtcttgaactcccgacctcaggtgatctacccaccttggcctcccaatgtgctgggattacaggtgtgagccactgcacctggccccaggcatatactattaattaatctttgacaaaagtacaaagaataaaacatagagaaaagttactctcttcaattagtggtgttaagaaaactggatatccacatgcaaaagaataaaattgaacccttatactgtaccataaagaaaaatcaaatcaaaatggattaaagaactaaacacaagactataaactataaaactcctagaagaaaacatcgtggaaaagctgcatgacattggtcttgccaataattttttggacaggacacccaaggcacaaggaataaaagcgaaaactaaacaagtgggagtacatcaaaccaaaaacttcggcatatcaaagaaaacaacaaaagtaaaagacagcctagaaattgggagaaaatatttgtaacccataaatctgttaaggagttaatatccaaaatatataaggaatttacataactcaacagcaaaaaaattaataacccaattaaatattaccaaagaacctgaacggatatttcttcaaacaaaacaaaaacctggccaatagataaaagcaaagatgcccaatattactaatcatcaggtaaatgcaaattaaaattacaatgagacatcacctcacacttcttaggatggctttatcaaaaagataagatcataagtgttggcaaggacgtggagaaaagagaacactggtatactggtggtggaaatgtaaattggaacagccatttggggacagagcataaggctcattgaaaaattaaaaatagaactacaatatgggtcagtaatccctcttctggatatacacccaaaggaaatgaaagtagtacttgtagatatatctgcactcacatgttcattgcagcattattcacaataaccaccatatgaaaacaaaacccgaatgtttctcaacagatgactagattttttaaaaagtataataaaatatgaatgtgattattattaaaatatattattatgaattatattaacatagtatattattactatattgataatgtaatatgtgtattataatatattactttaatataatatataatatatataatttatatatacatgtacatggtgaaactattactacaggtatgcactttaacatatccatcatctcacatggttacctttttgcatatatataatataatatatagtattcatatacatgaatattatttcaattttaaaaacaaggagatcctgccatttgcaataatatgaatgaagctggaagacattatgtttagtgaaataagccagactcagaaagaaaaatattgcacaatttctcctctatgtggaatacaaaaaaataaaaataaatagctgaatatgtagaaacagagaatagaacaacagtggttaccagaggcagagggtggggaaaatgggaagatatgtaggatgaataaatctaaagatctaaataaaatgtagtataaaaactatagttagtaatattgcattgtatcactgcaaattttctaacagggtagactttgggtcctctaaccaaaaacaaaaatatatatataagatgcaaaaagataaccatgtgagatgatggatatgttaaactgtgatatacatgtacatagtttcaccatgtacatgtatatcaaaacattaagttgtataacttaaatgtatacaataaaaaataaatagaaatgtgaaaatgaaagtaaagtaagagaagcattttttcaatcgaaggactcttccattaataagcatctcaaattaagttagaagagctgcttgagatttgctaccaaatcatatgctatacaatgttagtcccagaaggttagtcacatgacttgggagatacgaaccaggagcctccgtgcaagtctttgagttggaaatcagttatctgaggctgggttctgacgatgtcaacaaaggcgaagtggttctgcggtcagagaagcagcagcacctgtggagacgtggcaacataaccatggtgtcagagggacagcggctcctttggagcacctgtcccgacagatgtgcttctaaaagctattcctggccattcaggtcagactctgccattctaacccttccaaaggttctttaaacaacttaattgcatataataaatcccttctacttaaactacctacagacaattctgtgtcatcacctaagaaccatggctgatatactaaactgatctaaaattctctatttcaatttgtcacaaagaatggaaagccatcaattgcagaagcattctggttagcaagggtccctttgaaaactgcatttactcataacagcccattctttgcacagaataggcttgacatggaataaacatatgggcatttcttgtgctgcaaatgccatagtgaacaaaacagccaatacctctactttcacggatttcaattctaactggaaaaaatggacaaaaaaaaaaaaaaaaaacaattacatctgacaatcacgtggtgaaaatgttgacaacaaaatgtagcaaagtaatgtgatagaaaataactcaaagagatggagaatggctttacatggatggctcaagaagacctctaaggaggagaaattgaactgcagactgagtaatgacaaggaccaagccatgtgaagatctaaaagatgatgagcatttggggaataaagaagagctagtacagtggcccaagggcaagaatgaggtcactgcagctggagcacagtgaacaagcgagagagtcgtgctggatgagatcaaacagatacatgtttgagtggggaacaattgtatagactctgacaggaggtgaaaacatcaattacaattggttaaatagttttccttttacaaatcaacctagctcaacttcgctaagtgaattttttacatggggataaaagatagaaattaattttaaaacaatagtcatgcagaggcaaagtgcagatcaatgtcattgactacaccaaaaagtccatcagaaacagaaactaccagaggaacacacaaagacttctggagaaggtggttgcttggatgcatgtgctttattttgcttcatcccgattttagttagagatgaattaattataatatgataaatttagttggtgatattagggtcaaaagggaagagagaaattaaagacaagagttgcatcaggtcagataatatccctcctccacatacataaatttatctctactgttttacttatgactttcagctcattgttcctcaccctggataggttaaacactaaattcgtgcacttaaatctttttaaacacccaatctgaagtaatcccaccctgccttctgagttgctctctatcatgtcacagatttcacctttttaagcccttttcactctgaatttatcctttctttaaaaggtttatttattgcacatttccctgactagaatttttctttattcaaatgtgtgtcatttttctggtgtataccatagtgcctaaaagtgtaagttccaaagaaaaactacatgagctcaaatcctacctcaagtattcgctacctctgtgactaaagtaatttatttaaattttccaggcttcatccaattgtgttagaaatcaagaaaaacagtatctatttcataaggctcttgtgcagattagcaagacaatgactttctagcatgaaccacgttgaagtaaatactaataaactttagtaaaattattattataccataactttcttattagtcataaggattctattaaatttgatgtcttctttagactgattttgattttggagacattcacacttttttttttgcatactttaagttctagggcacatgtgcacaacgtgcaggtttgttacataggtatacatgtgccatattggtttgctgcacccataaatttgtcatttacattaggtatttctcctaatgctatacctccccctgaccccctaccccacgacaggccctggggtgtgatgttccctgtcctgtctccaagtgttctcattgttcaattcccacctatgagtgagaacaggtggtatttagttttctgtccttgtgatagttggctcagaatgatggtttccagctgcatccatgtccttccaaaggacatgaattcatccttttttatggctgcatagtatcccatgatgtatatgtgccacattttcttaatccagtctatcattgatggacgttgactacctagatcttggacttcccagttttagtgctgtgagacataaatttctattttttataaattagtctgtggtattttgttacagcagcatgaataaagtaagacaaagaccaaaataaacagaagcccatctactgttcatagatggaagacttaatataattaaggtgacaataatagtagtcaagaacattcagtggaaaatgaattatttcttcagcaaatgatactgggacaactggatacccaaatacaaaggaataaatttggacccctttctcttgtcatatacaaaaattaaccccaaatggatcaaagatccagtgtaaaatctaaaaccatataactattagaggaaaacagaggggtaaatcttcatgatcttggcattagacaatggttctttaaatacagcaataaacaggcaacaaatgaaaaatagacaaattgaactttatcaaaatttaaaacttttgtgcctcaaaggaaactatctagaaagtcaaagtcggttcataaaatgggagaaaatatttccaaatcatatatttgataaggatcttgtataaaaatatgtaaagaactctttacatctcaaaaataaaaagacaaacaactcaattaaatatgcacaaaggggccaggctcagctgctcatgcctgtaatcccagcacttttggaggccaaggcgggtggatcacaaggtcaggaaatcgagaccatcctggctaacacagtgaaaacccgtctctactaaaaatacagaaaaattagctgggcatggtggcaggtgcctgtagtcccagctactcaggaggctgaggcaggagaatggcatgaacccgggaggcggagcttgcagtgagttgcaattgggccactgcattccagcctgggcaacagagcgagactctgtcttaaaaaaaaatgcacaaagatagtgatgtcaaaagatagaatatgaggttccacatcacattccctcacagaaacaccaatataaatatccatccacacatgaaaataccttcacaagagttctagatcacaggtgagaacttacagcacccaagtagaagacacaatcaagaaaagatgcattgaatgagggaatgaacagctttactttacccaagtcaccccttccccaagcccatgcagcacaaggctaagagagaccctctctgtcccagggctctcttatgtggaaaagaaaagtgaagtgagaattgacttcactgcagacgcctattcaggcctgcaccaacagtctcaagcacaaggctgattcacgtgaacttaagcaccaggctcaccccagagccaggcaagtccccacagacccaggcttttaaaccaccccagcactaggccagctctcttagaccaagtcacaaaaccagccctagtaccaatgaggtcctcactaactcaaagccaggctggcacaagtagttaagtcaccagggctgcaccaccccttcaccactaaagcttcaggccagcacctttgcaaggccagcccatgtaactacaggaaccagacccaccccactgccagactagccccagtttcaggcctattctatggttagactgctatgtggatctaggttctaggcctgcctcagtaccaggccagtctccatgaaaacaggctatcagcccacctcagcaccaggcaggaatgcaaaccaggcaatagaccaacccctatggattcaactttcatgtctgccccagtgagcacctgtggaaggccagtacccatggaccctggcactaggcttaacacaggtacagctccaccaaggaggactcagtttccaccctaccccagttccaggctgtccctcaaaaatgcagactcaaggtctgctccagtgccaggccagcccacataaacccaggttgtaaactcaccctggtggacccaggctccaggctcacaactgcagacccatgtgtcaggtctattcccactggactgtaatgcaaggccaaacctgtggaaacagacagcaaggttatctgcctggagacctctgcagtcaaactgcccatagtctcttcaactgttggctcacacaggaattctagacaagctgactggtgaaggactttcccagcagaagccagcctttacaggctacaagagatgataacttcttcaaatgcaaagacacaaaagcaagtttataagaatcatgaaggatcagacaaacatgataccaccaaaggaaataaataaatcaacagtaattgactctaaagaaatggagatatatgaactgtctgacaaggaattcaaaataattgtcttcaagaattcatgggaatacataatgcagataaacaactttaaaaattaggaaaacaatgcatgaacaaaattagaagttcaataaaaatatataagccataaaaaggaatcaaacagaaattcaagagaggaacacagtgacctgaaaaattccataaagagagctgcaaagcagactcaaccaagcaggagaaagaatcagcaagcttgaagacagatcgcttgaaacttgtctcacttggagggaaaaaaaggaaaaataaagttaaaagatcctttggtatttctggaacaccatcctgtgtgtcaatgtatgtattatgggctacccagaaggaacagagaaagaaagagaagctaaaagtatgtttaaagaaatgataataaagaaaagagtccccaaatgtaggaaggaatataaacatccagacccatgaagcccaaagatctacaaaagttaggacataaggatgtcttcaccaaaacacagtagaatcaaattgccaaaattaaggataaagagagaagtttgaaagcactaaggaaaaaatgacttatcacatacaaaggaataaaactattagcagatttgtcagcagaaaccttgcaagccaggagagggtgagataatatattcaaagtgctgaaagaaaaagaaagagaactatcaacacaaaatactcagaaaaactgttcagaaataaaaaagagataaaactttcccagacaaacataatctgagtgagttcatcaccactggacctgccttaaagggaatactaaaggaaattcttcatgcttgaaacaaaagtgagctgaaatgaaaggacactaactaacaacatgaaaacatatgaaagcataaactcctcggtaaggatagactattctaatactatagtagcctggaaataaacccaatatctattaactcatctttgacaaaggtgtcaagaacacacagtaggaggaagaagagtctcttcaatacatggtgttagaaaaactgaatattcacaaacggaagaatgaaattggactcttatctcacaccatatacaaaaagcaaatgaaagtggattgacaacttaaatgcaatacctgaaactataaggttagtagaagaaaacagggaaaataaaatcttgattttggtctggacaatgatattttaatctgataccaaaagcagaggtcacaaaagcaaaaataaatgagcagtattgcatcaaacgaaaagcttcttcacagcaaaggaaacaatcaacaaagtgaaaaggcaatctatggaatgagagaaaatatttgcaagccatgtatatgattaggagttaatatccaaaatataaaagaagcacatacaactcaatagcgaaaaaattaaaaaatggacgaagaatgagaataatcatttctcaaaagaaaatatattaacttccaaccagtatttgaaaagatactcaatatcacttattattatagtaatgcaaatcaaaatcacaatgaaatatcacctcacgcatgtaggatagctatatcagaaaaaagataaatgttagtgaagaagtggtggaaagaaaacccttgtgcacagttggtgagaacataagttgatacagccattgggaacacagtatagagatcccccccaaaattaaaaagcttctgatccagcaatctcacttctggttgtgtatccaaagaaaatgaaatcagtatcttgaaaagatacctgtattccatgtttattggagtattattcacaatacaaggatgtagtaacaatctaattgcctgttggtaacttaatggattagaaaagtgattttatatacacataaatattattcagccttaaaagaaaagaaattcttccatttgcaaaaacatggataaatctgcaggacattatgctaaacaaaataagccaggcacaaaaagacaaatattgcatgtcctcacttttatgtaaaagctaaaataataaaactcatagaaacagtgaatagtatggtggttgtgaggggctagagcagggagaaatggaaatgctggtcaaggtgcataaagttgcacttatgtaaaatctgttgtagagctaaggtacagcaaagtgactatagttattactacagttttgtatacattacagtagatttaagaaggtagagcttaagtttctcaccataccaataaaagtaattaactatgtaaggtgatgagcatattaattatgttgattatggtgattactacccaatgtatacatatataaatcatcaatatgatttataaaaatttcttgaatataaaattgagtataaaaatttcttgtcaaatatacctcaataaagtaggaggagggaaagaaaaatagcatttcaagtcctttaaaatggctgccattaatttcatgccctcagtgctctagatctcaagcaatcaataacatttttccaaaaaaggtttcatattaggtgaaaaaatagcagctctttctgtagcatgagtcgacagggaaactacatggggtgcccactctggaattatgccaccttgccatttacatggcattcagctttcttagaagcctgggttcagataggaaaaagggactctcacaggcttaagttttaaatacacagaattcaattccccattcaggatgggtgtttttcaaacatgtctccccagaatatctgcttctaagacaaagtctttccatcaaaggagataattaattcctgggagagaaagcaatagctaaaagacaaggtctctgaatctttgtagaaacctctttaaatacacatgcagtacaaggtaaaaatgttttttgttgttgttgttcacatctccaaagcaagattcatcaagaattgagtgactcatttacatgtatttcctccacactttcttcatcttaccctgaggggaccagagccatgtaacatcatttttttgtgaaaatgttcagaggctttaggctagaagaaaatatttagacttacaaagagactttcctaacaactgttgatttgatattgaatcacctgaataaactcttttgaagtgtgaaatatctttcacattgaaacttacttatcccaagaaaagataatctcaaataggattgtgtctgagcacccctaaacatcattaagatcatcaaagacaactaaggtaagtttttcaatagtgctgaagcttgtcaaagattgttactttctatatatagtaatcagtatttttcaacactttccaatagagtaatagagtcttgcattctcactccaattattcaaaaggtagttggtaaatatcattaacctaatttgacagttgaaatatttgaggcttatagagattaagcaatttgtagaaccaatctctctgatattgggtaccatgctttcgccatgagacacctccttagtgaatgagacaagttatgaggactaaagcaaaatttaaatacacttcacacacacaaaagacagaaatatgaatattaaatgctatgaataatataaagccctgtaaaaggaaaattggagacctttctttgtgagcttaatgcgtgggcaaatatttctctgtattatattgatcacactgtcaatttatcctgtctcctaggcttatacagccataaaaacaaatgaaagtcctctgtatgtccctaacagtagggtagatatattcatatatgttctcccaattaattctcataacagtatgtgaggtgaatattattatcattttatggatgataagattaagatggaaggtgccaagaaatataccccaggtaaaagaagttataggtggaaaaacgaggattctgatctagtctttctgattctcaaactaacacacttaactattgtgataatggtttttaacactttgcagaagattctggctagggtcccgtgctttggaaggggattaagaaggaatggatagtgctgagggaggggctaagcaaaaacagcccttcagtgaatgtaataccacatttttcttaatatttaggagtttcaatatatcattatgtgtgtgtgtctgtctgctgatgaagttacttcatataaacttgtctctgaagtagtattaaagtaattataaaaattatggccatatcaaagggaaattaaaagttcaacattgtttattataacaatataaggcatgagttaagacttcggagggaaaaaattaacaagcataatctgaaacttaatattgggtccagccttgattatctgctcgatcttgggaggaaacttaatttctatgtgtttctatttcctaatgtgtaaaataagtgtaaaaagacaatagtaactaatacataggttttcagtgaggattcaataagcaaatgtctgtaaaaacacttgaaaaatgctgtgttcagtaaatattagttaatattaacactataactattaatattagtcactgagattgtgtcctcatctgtaaaattgataaaatgagatcatgtgtgcaaagcacattctacaatgtcatgctcatagcaattattcagaggtgtatattattagctattataaagttaataggacttagacaatagattatgaattcttttatagtagctcttatattctttctttacattttcaccacaaattcactgttagtcttatgtcaactactctaaatagtctgctaactaagttccattatctggcttccagctccttactggatctcagcccacgtcacaaaaaacacacaaagaccttcactagagaaatatcccaagaatcccccttcttcagattcctctttatcatttcactcatattgtgcataacatttcatatttcattattttctaaaaaaagagagagagagacagagagcaaattttgagttttgcattcatgtgctttacatctatattctataatcttttcaggcttagttgccactatgtgtgcaatcattcaacttttagttgtttcggatgattaagtgttcacagatggtctcctgcatgtgtgctacaaaagtttctcatgtcaaaactcttagcacagttttcaccagggaggaaatttcagtaaacctccaaaacccaaaacttttttcctgtctcagaaaaaatcctcaaatcacaacccagtagaatccaagaatttattatattacaaattacaatggagaagtttaacaaatttaaagatgtattaataaaaattgttttcttttcaggtaatgcaattagccaccatttgaaatacatggcgaatagaaacaacgtgacagagtttattctattggggcttacagagaatccaaaaatgcagaaaatcatatttgttgtgttttgtcatctacatcaccaccatgataggaaatgtgctcattgtggtcaccatcactgccagcccatcattgaggtcccccatgtaatttttcctggcctatctgtcctttattgatgcctgctattcctctgtcaatgtctctaagctgatcacagattcactctatgaaaacaagactatcttactcaatggatgtatgactcaagtctttggagaacattttttcagaggtgttgaggtcatcctacttactgtaatggcctatgactgctatgtggtcatctgcaagcccttgcgctataccaccatcatgaagcagcatgtttgtagcctgctagtgggagtgtcacgggtgggaggctttcttcatgcaaccatacagatcctcttcatcttccaattacctttctgtagttctaatgtcatagatcactttacgtgtgatctcaaccctttgctcaatcttgcctgcactaatacccacactctaggactcttcgttgctgccaacagtgggttcatatgcctgttaaactttctcttgctcctggtctcctatgtggtcatactgtactccttaaggacccacagcttagaggcaaggcacaaaggcctctccacctgtgtctcccacaacacagttgtcatcttattctttataccctgcatatttgtgtacatgagacctccagctactttacccattgataaagcagttgctgtattctacactatgataactcctatgttaaaccccttaatctacaccttgaggaatgctcagatgaaaaatgccattaggaaattgtgtagtaggaaagctatttcaagtgtcaaataaatgtgactggagcccaacatgattcagctgaggcaagggtcaaaaggacattttgggtaatgtcagcaaggaatacttattggataaataaaataattaaccactgtgatccatagatgatgccttgaggggagtcaaaatgggttcaagaaaaaggagaaaacctaaccgtgtatcattctcacaaactgggaaaattctaccaatttggggcttagtttcactagcttcatccatatatatgaaactcataggccttccttctaataaatgtaaaataagtaataaaataaatatatctatattaagtaataatgtccataacaaactgagggaggcattattcttatccccatttaccaaagaggaaactgagagaaggggacagtgtcaaaatagaagtataaaatagacagtaatcagaatctcactgatttcccaaaccatgtgcttaactaccatgataccctgccagaaagatcagatcattataacagctatcatttattgagacaaggactatgctggacacattgtatatgttagttcattaaaaatataactttttcattaataattctttcacgtttatatatcaaaattaatggcctttgttttctgaaatattatgctgtctaactacttcagggctgtaaaaagcaaagaactatttagcatctgatgggtaaacaatgaagtttataccatgattccaaatgtccttgtaggcttcagaaccattttgtattactcatgttaccctttttatactgataatcaaccagaaagagtgatggttcaaataaagaagatgttttgatatcaaggagaaatttctatttattaaatatacagttatactccataaagtacttgcccgatagataacaatagttcctgcaaggtaccatgtctggtataccataaacagaatcaatgaataaaaggattaatgaaaatgaataaattcaataaaatataaagcaaaagttgtagtggaggctaggaaagtattttctatcttcagactaagaattctggttggacctcatagggaaaccacgttttttcactcttattgaaacaatgagaaagaaattgaaactgcattctcagcatatgaacatgtagtttatcttgatatttttcctactcccagtaaaattttattatcttatgtatatgggctgtttatatttttctagcaatcagtttgctttttggtaacattttcatattaaaagctgttttgtttgttgtttttgagacatagtctctctctgttgcgaggctggagtacagtggcacgatcttggctcactgcaacctccgcctccaaggttcaaatgattcccctgtctcagcctcccaagtagctaggactacaggcacctgccactatgcctggctagtagagatgggatttcaccatgttggccaggatggtctcgatctcctgaccttgtgatctgcccacctcagcctcccaaagtgctggattgtcggtgtgagccaccacacccagtctaaaagctgtttttcaaattatatagctacacacaaagcaatttcaggataactgtattccacttattccttgcattcttttttccttaatcaacaaatactttttatccctaggaatgtatcaggcacattgatagttcctggggcttagtggtgaataaagagaaaccagggtcctcttttcacaaaagttaggatactctgagacacttcaagaagagaacagagaattacaacataatactataaatagtaagatcacggaattacagagtgctgtgaaagcatgttagaaggacacacaacaaagacctaggagatctaaagaggatgcctagatgaaaagacatcaaaaacagaagctgaccaggcacagtggctcatgcctgtaatcgcagcagtttgggaggccaaggagggtggattacttgaggtcaggagttcaagatcagcctggccaacatggtgaaaccgtgtctctactaaaaatacaaaaattggctgggcgtggtggcacatgtctgtaatcccaactacttgggaggctgaggaagaagaatcacttcaacccaggaggcagaggttgcagtgagccaagatcttgccactgcactgcagcctggctgatggagcaagactctgtctcgaaaaagaaaaagaaaaagaaaaagaaaaaacagaagccaaaggcagaaaaggggtcagcagaataagtaggcataaggttgagctaagaggtgcatctatgagagggaataagtaacaaaggccagaagatgagaaagagtcagcaggaaacccaaacaatttgctatgactgtaattatcaatttatctattcattcatcaattatttattgaacccccgttgtgtgccagtgtaggacactgaggttgtaaaagggaaaatacaagatatgaagctggaaaataggatcttggtaagatcaaaaagggtctcataattgtgttaaaaataaatactaagtacaatggagaaaatagtgaaagtacttttaaactagcaagaaacttagttggatttgttttgggaatgataactctagctacagtatggaaaatggattgaagggtcaagcctcccaagagaagaacagctaggaggtaattataatgatttaggtgtgaataaatgggagtctgaacttcggtgactcccaagagatgctgaattttagggacactgttgcatccagctcaaatgccctttgcctggtaagtgaattcatgccccacctgctgtgtctgggctgctaacagctcagagccccacccttccctggacaattgcaccacagaaaataggaggtgcaacacccagaagattatgcccaccgtcaggacccagcagtggccaatgactaacagacatgaaagtttaaaaggttgctgtataatacaatgtatcctccagagcttcaacggctccagactcaattgaggcagacttcaattgagaccacatctgaagccagactccagttgagatcatgtcctttcttccctctaccatagttagcttcccttaaccccttctccttataagtcacttttgtaaaaattctcaatttcagatatgcatctaagaaacccaaactaacgcagagtaatagagacagtttaagatacattaatgaattttgaggaaaataacttgatataggatgaagattagagagaaaacagtcggggatgaaactatgtttctgcttcagaaggaggatactgagaagatggaacagagaaaagataagcctgctttgccagctgaagaggcctccccacctctagtagaacctttccttcactcttagtggaagaaacctcttcacccctactgaaagtttaaccttgcgttgcctgaggaaattatatgtccttccctgaagcagtttcccagcaaaacaatgttgatttccctcaagacccatcttcatcatccctctttgcttctagacctataactagactcaagtttaaactcaactgtgaaaggttaagctgtggtgttgcagatggcatctgaactcactcccagaagacgataaacgttaacttcagaacaaatcaagaaaacttgatttgaatgcaaataaagcaatgttattccctaaaaagtcttgagtttatcacacagtttcagtcaggttagctgaagttgtattagtaagggagtggggaaagagaaaacaaatgtaagattattctatttatctctaagtgctcatggaacgcatgccacaatagaaaatacactgggccacagtacaagatgcagtacatttcaaaggactaaaccatacagaatacatatctaataatagtaggcttcaactaaaaatttataacaaaaatataactaaacattccccaattatttacaaatcaagaaacacaattctaaattattcatatattaaagaagtgccaatgaaaaatttttaatgaattttaactgaaaggcagtaaaaacaaaaaaatactagatggcagctaaagaattgctcagagagaaatatatagctttaaatgcaattattataaaataaaaaagattaaaggaaatgaactaagctttcatctccagaagctagaaatagtagagcaaaataaatgcataaaacatggtatgatatgaatagtaagtagaagacagaaatacttgagataaaattaatttaaaaatagagaaaatacataaagataagggttggttttgtgtaaaaattaataaaactaatttccttagcaaaattggttttaaaatataaggaaaaaaaacaaattatgagaatcagcaatgaaaaggctatgctgtagattctacagatcttaacaagataataaaaagacattacaaatgaattttgctaatgtccttgccagttaaaaagaaatggacctctgctttgaaaaacacagttttctactttttgtcattcaaaaatgcctgtaaaaacaatatttgattgaataaagaaaatgtatgcatcctccatacgcaaagagtcttacaagttaattagaaatcattcagctacaaaatgagcaaaggacaagaacaatttccaaaagaagaatgaatggtcattcttgaaaaactttcaacttcattagtatgaaaaaactttcaacttcattagtaaccagagaaatgcaaatttaaaatatttatactaagcaacttttaatttttattgacaaataataattgtacatatttatggggtaaatagtgacattttgatacacataatgtatagtactaattcagggtaattagcatatccattatctcagacatttatcatttctttggaaaaatgcaactttctaaacacacacacacacacacacacacacacacacaagcaaaacctgaataacatacatgtgctaaatccgctcttgaaaaatttcccctgacttctcccaaaaatatcagattacatcccatgtagctttatcagtgaattatacatatcacttttaaaaaatactaccaattttatctcaacattttaagggattagagaaaatgaaaaagggcattataagaaaaaatatcagataaatatctctcattaacacagacacaaaaattctaaacccaatatttagcaaataaaatacagccatatataaaaataataatgtatcatgagcaagtaagttttgtcccaggaatgaaatgttgatttcacattcaaaatcaattcatggccacatgcagtggttcacactgtaatcccagcactttgggaggctgaggtgggcagatcgcttgatctcaggagttcaagaccagctggggcaaaatactgagaccaccatctataccaaaaaaaaaaaaaaaatttaattagccaggtgtggtggcatgtaccatagttccagctacttggtaggctgaggtgggaggatagcttgagcccaggaagttaaggctgcagtgattggtgattgtgtcactgccctccagtctgggcaactgagtgagaccctgtctcaaaaaaaaaatcaattcatgtaattcactgcatgaacaaaattaagtagaaaaaaatatgatcaattcagtaaatagagaaaaaacttgataagatttaacatacattcatgatttttaaaaagtttaagaaaactaggaatagaacttcctcagtaggataaagcctattaacaaacaccctacagccaacattgtacttaatgaggaaatactaaaaactttctctgggagtcaggaacaatgcaaaactttccattataattacatctattccacattgtgctggagaatctaaccagtgcaataaggcaaagaaaagaaataagtggcatttataaaaatgactaggaaaaattttaaactgtcattatttgcatacaataattttgtgtgtgtagcaaatcaaaatttataaactattaaaactaatacatttatgagatgctacattgtattaaaaatttacaattaaaaatatgcaactacaagatgactgactagattcagctggggtacacctcttccacagaaaggaaccaatatcaagtagatattcacactttaaacagatcgtgtgagaaagagcactggaattcaacaaagagacaacaggagacactgagggtgaaggaaggagatatggggctacctgtttggggttgctaggagccaagagctgccccagacccaaagaaggggtaagtgacggaaccccagagctccatatttctgctgcagaattccataatcctagctgtaggagagtccctcaaccccataggcctctggactggcatagagagctgcctggacatcatgcacaggtgcttctcaaacttacatggagtctcacaagcttctaagcactggacagctgcagcatggtgccattctaggagcccattccccagggatctctttcctgccctgaggctgccactgccactgctggctgctgggccaggtactgagaggggaggccaggggctctcacatgcctcaaggagaggttccactgcttctgctgtgggactgaggtcatttggaccacatgccccatgtctgccagtctctcccaaagctgtctgcctagccattcctatggagagaggaccacccttccaagaggcaggcccacagtgcagccactgttgccctacgtgagtgttcctccagtggccagggaccagctttccctccctaacacagccagcacttgagtccaggaaccccaagggcaaggctgctggcctgatcctatcactgcacaattcaagcatgtcatccaggagcatggagatgagatttgtgatctgatctgatctgatctggagccccccacagccagaagtgagagaagagtgtggtgtgggttcatactgttgtacaggaactgggtacccctcccttcatagtaccagaccaggtagggtgtggcctgagagccaaagtttctgccccagacaaggagtttcatggcctggggaggcttttccatctgaacacagacagcttaggatgtgcctagaggttctggccagctgttggtggcctaatgctgtagggaaacccatggggttggaggtttgggggtggagcaggtcccactgccacttccagctgctgattcatggccacccttcccctctagcatgaaggtgctttgatgcagcagaagtggctctgccccttcctggagggttgctccagtagcctgaaacctgaccccaaacccccagcagaatcagcacttgcaccagctttggagatcctggttcaggacttcccagacccagccgtgcctggctttgccccatccaaccactgcagcagcagagcacaggacagggagccctgggagttccatggccccaccccttacatgagacacccagagcttctgtaatgaacaaaatccaaggaaaaatcccactgctccctctctcttggaaatgccacctactggcttagaagtcaacctgcacagcttatttaactgcccacacaactgcccagtgctcagctggcttgtatctgcaagtgccacctactgacctgtaggtaaaactaaacaacccaatacaatccctgctgacagaagtgcacaatgctggggaataaaataagagacttccccctgctcatctttgcaggaggcagtgatccttctcacatgcccaatccactgccactacaatgtacaaagaatagtatttgagaaaaccattacactaaggctatcatcaaaaaattcatagatttggccccctgaaagtacccagaagcaaagtcaaaggaccctacacaatatatcttatagtcacaccctcaagaggggaataaatttctatccaaacaaaagtaaatccaaaaaggaaacagcataagaattctgggatcatagaaaaaaagagtgttgcaacacacccaaaagatcacactacctctctagcaatggatactgctccccacatccaaggctgctccagcttctgccacagctcaaagggatcctggcacagctcaggttgccactctagagggcacaagccataagctttggcagcttccatgtggtattaagtctgctggtacacagagtgcaagagtgaaggtggcttggcagcctccatctacatttcagaaaatgtatgagaaagcctagatgcccaggcagaagcctgctgcaggggtggagcccttatagagaacctctaatgaggccccacacggagtccctactagagctctgcctagtggagctgtagaaaggcaactgctacagtccagaatccagaatggttgagcttgcaacctaagcatggaaaagtcacagggcagagcagcccaaggctttgggagtccactccttacaacagtgtgccctggatgtgggacatagagtcaaaggagagtatttgggagatttaaagcttaatgactgccttgctgggctttgaaattgcatggggcctatagcccctttcttttggctgatttctcccttttataaagggaatgtttacccaaagcctgtactactattgtttcttggaagtacataacccattttgattttacaggcttgtagatggaagaaactaatctccaggtgagactatggacttggacttggtacttttgagttaatgctggaatgaattaagactttggggggctattgggaaggaatgattgtgttttgcagtgtgacaaaaacatgagattggggaggatgggggtggaatgatagagttttgatatttgtctccacccaaatcttacgttgaaatgtcacccccaatgttggaggtggggcctaatgaaaggtgtttgggtcatggaggtggatccctcatgacttcgtggtgtcctcgtgatagtgagtgagttatcttgagatcaggttattttaaagtctgtgacatcttccccacactttgctcctgctctggctgtgtgacatgcctgctcccacttcaccttccaccatgagtaaaagcttcctgaggcctctccagaagtcaagaagatgccaatgccatgcttgttcagcctgaacaactgtgagccaattagacctcttttgtttctaaattacccagtcctgggtattcctttatagcaatgtaagaatggtctaacatattcaccatcataaaaacacacaaaagtataaaatttacaggtcttataaagcagttacacaactgaaactacaaagccattaggtaacaattaccattatgacagggaaaaaactcacatatcaatatcaactatgaatggaaatgattaaatgctccacttaaaggatatagactggtggaagggattaaaaaaaaaatccagaccgggcccagtggctcatgcctgtaatcccagcactttgggagaccaaggcacgtggatcatctgacatcaggagtttgagaccagcctgtccaatatggtgaaaccctgtttccactaaatatacaaaaattagctgagtgtggtggcacacatctgtaataccagctacttggaggctgaggtaggagaattgcttgaacccaggagacagagattgcagtgagcagagatcatgccacatcactccagcctgggagatggagctagattccatctcaaaaaaaaaaaattcaaccagatgctgcttattacaaacccacaaaattgttgaagacaatttgcaggctcaaggtaaatgtgtgggaaaatatattccatgcaaataaaaacccaaagcaagcaagagtagccatatttatatcaaacataacagacttttaaatcaacaacagtaaaaaaaaagacaaagaaggttattatctaatgacaatgtataaattcaacaagttataacaatcacaaatacataaacacccaacatgagagcacccagaaacataaaacaaatactactagacctaagaaaaggtgtacagtggaataggaacagctccagtctgcagctcccagtgagactgacgcagaaggcaggtgatttctacatttccaactgaggtacctggttcatctcattgggactgattggacagggtgtgcagcccacagagggtgtgccaaagcggggcaggctgttgcctcacccaggaagtgaaatggatcagggaatttccctttccaagccaagagaagctgtgagagactgtaccaggaggaacagtacactcctgccaagatactgtgcttttcccatcgtcttggcaaccagcagaccagaagattccctccagtgcctagcttggtgggtgccaagcccatagagcccagcaagctaagatccattggcttgaaaatctcactgctagtgcagcagtatgagattgacctgggatgcttgagcttggtggggggaggggcatctgccattgctgagtcttgagtaggcagttttatgcttcagtgtaaacaaagatgccaggaaattcaaactgggcggaacccaccacagttcagcaaggcggactgcctctctagattccacctctgtgggcagggcatcactgaacaaaaggcagcagcctcagtcagggacttatagataaagcccctatctccctgggacagaacatctgggggaagggacagcaggggcacagcttcagcagacttaaacatctctgcatgacagctctgaagagagcaaagttctcccagctcagccttcgagctctcataatgaacagactgcctcctctagtgggtccctgacccccatgtagcctgacttggagacatctcccagtaggggccaatagacacctcatacaggagaactctggctggcatctggctggtgaccctctgggacaaagcttccagaggaaagatcaggcagcaatagttgctgttctgcagcctccgctggtgatacccaggaaaacagggtccagagtggacctccagcaaactccaacagacctgtagctgagggtcctggctgttagaaggaaaactgacaaacagaaaggaataccatcaacatcaacagaaaggacatccacaccaaaaccccatccataggtcacctacatcaaagaccaaaagtagataaaactacaaagatggggagaaatcagtgcagaaaagctgaaaattcaaaaaaccagaatgcctcttctcctccaaaggaacacaactcctcataaacaagggaacaaaactggatggagtttgaatgagtttgacaaattgacagaagtaggctccagaaggtgagtaatatcatactcctccaagctaaagaagcatgttctaacccaatacaaggaagctaagaaccttgaaaaaacgttagaggaattgctaactagaataaccaatgtcaagaggagcttaaatgacctgatagagctgaaaaacacagcaagagaactgtgtgaagatacacaagtttcaatacctgaatcaatcaagtggaaaaaaggatatcagtaattgaagatcaacttaatgaaataaagcaagaagacaagattagagaaaaaagagtgaaaagaaatgaacaaagcctccaagaaatatgagactatgtgaaaataccaaatctatgcttggttggtgtacctgaaagtgacagggagaatagaaccaagtttgaaaacactcttcaggatattatccaggagaacttccccaaccttgcaaggcaggccaacattcaaattcaggaaatacagagaacaccacaaagatatgcctcaagaagagcaacccaaagacacataattctcagattcaccaaggttgaaatgaaggaaaaagtgttaagggcagccagagggaaaagtcaggttacccacaatgaaaaggcaatcagactaacagtgaatctctctgcagaaaccctacaagccagaagagggtgggggccaatattcaacattcttaaagaaaagaattttcaacacagaatttcatatccagttaagctaagcttcataagtgaaggaaaaacaaaatccattacagacaagcaaatgctgagagattttgtcaccatgaggcctgccttacaagagctcctgaaggaagcactaaacatagaaaggaacaaccagtaccagccactgcaaaaacatgccaaattgtaaagaccattgacactatgaaaaaagtgcatcaactaatggtcaaaacaaccaactagcatcataaggacaggatcaaattcacacataacaatattaaccataaatgtaaatgggctaaataccccaattaaaagacacagactggcaaatgggataaagagtcaagacccatcagggtgctgtgttcagagacccaggtcatgtgcaaagacacacataggctcaaaataaagggatggaggaagatctaccaaccaaatggaaagccaaaaaatgcaggggttgcaatcctagtctctgacaaaatagactttaaaccaacaaagatcaaaagagacaaagaaggccattacataatggtaaagggatcaatgcaacaagaagggctaactatcctaaatatatatgcacccaatacaggagcacccaaattcataaagcaagttcttagagacctatagggagacgtagactcccacacaataataatgggagactttaacaccccactgtcaatattagacagatgactgaaacagaaaattaacatggacatccagaatttgaactcagctctggaccaagcagactagtaaatatctacagaactctccaccccaaatcaacagaatatacattcttctcagcaccacatcgcactcattctaaaattgaccacataattggaagtaaaacactcctcagcaaatgtaaaagaacagaaatcacaacaaactgtctctcaggccacagtgcaatcaaactagaactcaggattaagaaactcactcaaaaccgctcaactacaaggaaactgaaaaacctgctcctgaatgactaccaggtaaatagtgaaatgaaggcaaaaataaagatgttctttgaaaccaatgagaacaaagactcaacataccagaatctctgggaccatttaaagcagtgtgtagggggaaatttatagcacaaaatgcccacaagtgaaagcaggaaacatctaaaatcgacaccctgccatcacaattaaaagaactagaggagcaagagcaaacacattcaaaagctagcagaaggcaagaaataactaagatcagagcagaactgaaggagacagagacacagaaaaacccttcaaaaaatcgatgaatccaggatttggttttttgaagagatcaacaaaattgatagagtgctaccaagactaataaagaaaagagagaagaatcaaaccgacgcaataaaatttgataaagaggatattaccaccgagcccacagaaatacaaactaccatcagagaataatacaaacacctctaagcaaataaaactagaaattctagaagaaatggataaattcctggacacatacaccctccaaagactaaaccaagaagaagttgagtctctgaatagaccaataacaggctctgaaattgaggcaatcatttatagcctaccaatcaaaaaaagtccaggaccagatggattcacagccgaattctatcagatgtacaaagaggagttgatatcattccttctgaaactattccaatcaatagaaaaagagggaatcctccctaactcattttatgaggccagcatcatcctgataccaaaacctgacagagacacaacaaaaaaagaaaattttaggccaatgtccctgatgaacattgacatgaaaatcctcaataaaatactggcaaactgaatccagtagcacatcaaaaagcttatccaccacaatcaagtcgcctttatccctgtgatgcaagtctggttcagcatatacaaatcaataaatgtaatccatcacataaacagaaccaatgacaaaaaccacatgattatctcaatagatgcagaaaaggccttcaacaaaattcaacagcccttcatgctaaaaactctcaataaactatgtattcatggaatgtatctcaaaataataagagctatttatgacaaacccacagccaatatcatactgaatgggcaaatactggaagcattccttttgaaaactggcataagacaagtatgccctctctcaccactcctattcagcatactattagaagttctggccagggcaatcaggcaaaagaaatgaagggtattcaaatagaaaaagaggaagtcaaattgtctctgtttgcagataacatgattgtatatttagaaaaccccatcgtctcagtgcaaaatctccttaagttgataagcaacttcaccaaagtctcaggatacaaaaccaatgtgcaaaaatcacaagcattcctatacaccaataaaagccaaacagagagccaaatcatgagtgaactcccattcacaattgcttcaaagagaataaaatacctaggaatccaacttaaaaggaatgtgaaggacctcttcaaggagaactacaaacaactgctcaaggacataaaagaggacacaaacaaatgaaagaatattccatgctcatggataggaagaatcaatatcgtgaaaatggccatactgcccaaaatcatttatagattcaatgctatccccgtcaagctaccactgactttcttcacagatttgcaaaaaaatcctttaaatttcatatggaacaaaaaaaaagagcccatacaacccaagacaattctaagcaaaaagaataaagctagaggcatcacgctacctgacctcaaactatactagaaggctagagtaaccaaaacagcacggtactggtaccaaaacagatatatagaccaatggaacaaaatagaggcctcagaaataatgctacacatctacaaccatctgatctttgacaaacctgacaaaaacaagaaatgaggaaaggattccccatttaataaatgttgctgggaaaactggatagccatatgcagaaagctgaaactggatcccttccttacaccttatacaaaaattaattcaagatgaattgaagacttaaacataagacctaaaaccatagaaaccctagaagaaaacataggcaatacaattcaggacataggggtgggcaaagacttcatgagtaaaacaccaaaagcattggcaactaaagccaaaatcgacaaatgggatctaattaaactaaagagcttctgcacagcaaaagaaactatcagtagagtgaacaggcaacctgcagaatgggagaaaatttttgtaatctatccatctgacaaagggttaatatcagaatctacaaagtacttaaacaaatttacaagtaaaaacaaacaaccctatcaaaaaatggggaaaggttatgaacagacactgctcaaaagaagacatgtatgcagccagaaaacttatgaaaaaattctgatcatcactggtcattagagaaatgcaaatcaaaaccacaatgagataccatctcacgccagttagaatggtgatcattgaaaagtcaggaaacaacagatgctggagataatgtggcaaaataggaatgcttttacactgttggtgggaatgtaaattagttcaaccattgtggaagacagtgtggtgattcctcaaggatctagaactagaaatagcatttgacccagcaatcccagtgctggatatatacctaaaagattataaatcttttgactataaagacacatgcacatgtatgtttattgcagcactgttcacaatagcaaagtcttggaaccaacccaaatgcccatcaatggtagactcgataaagaaaatgtggtggcacatatacttcatggaatactatgcagccataaaaaaggatgagttaatgtcctttgcaggggtacggatgaaactggaaaccatcattctcagcaaagtaacacaagaagagaaaaccaaacactgcattgttgggagcaggccccccaaaatctggccataaactggccccagaactggccataaacaaaatctctgcagtgctgtaaaatgttcataatggccctaacgcccaagctggaaggttgtgggtttacaggaatgaaggaaaggaactcctggcccgcctagggcagaaaaccacttaaaggcattcttaagccacaaacaatagcatgagtgatctgtgccttaaggacatgctcctgctgcagttaactagcccaacctattcctttaatttggcccacccctttgtgtcccataagggatacttttagttaatttaatatctacagaaacatgctcatgactggttttctgttaataaatacgtaggtaaatctctgttcaggctctcagctctgaaggctctgagacccctgatttcccacttcacacctctatatttcagtgtgtgtctttaatttctctagcagcagtgggttactgtctccctgactaagctggtctcggcactgcatgttctccctcataagtgggagttgaatgatgagaacacatggacaccaggagaggaacatcacacacagggacctgtcagggggttgggggctggtgcaaggatatcattaggagaaatacctaatataaatgaagagttgatgggtgcagcaaaccaacttggctcatgtatacctatgtaacaaacctgcacattgtgcacatgaactccaaaacttaaagtataataaaaacaaaaattcaaaaccatagaagaaaaaagacattgtaaagttcctcaatttacttgagaagccattattatgttgaaataataaaatttaaaaagaaaacttctcggccaggcacagtggctcatgcctgtaatcccagcactttcagaggccaagacaggcagatcatgagaccatcctgtctaacacagagaaaccccatctctacataaaaaaattagccgggtatactgtgtccatgtgttctcattgttcaattcccaactatgagtgagaacatgcagtgtttggttttttgtccttgtgatagtttgccgagaatgatggtttccagcttcatccatgaccttacaaagtacaagaactcatcattttttatggctgcctagtattccatggtgtatatgtgccacattttcttaatccagtctatcattgttggacattcggcttggttccaagtctttgctattgtgaatagtgtcacaataaacatacttgtgcatgtgtctttatagcagcatgatttataaccttttgggtacatacccagtaatgggatggctgagtcaaatggtatttctagttctagatccctgaagaatcaccacactgactcccacaatggttgaactagtttacagtcccaccaacagtgtaaaagtgttcctatttctccacatcctctccagcacctgttgttccctgactttttaatgatcaccattctaactggtgtgagatggtatctcattgtggttttgatttgcatttctctgatggccagtgatgatgagcattttttcatgtgttttttggctgcataaatgtcttcttttgagtagtgtctgttcatatcctttgcccactttttgatggggttgtttgtttttttttcttgtaaatttgttgtatttcattgtagattctggatattagccctttgtcagatgaatagattgcaaaaatgttctcccattctgtaggttgcctgttcactctgatggtagtttcttttgctctgcagaagctctttagtttaattagctcccatttgtcaattttggcttttgttgccattgcttttggtgttttagacatgaagtccttgcccatgcctatgtcctgaatggtactgcctaggttttcttctagggtttttatggttttagatctaagtctttattctatcttgaattaattttgtataaggtgtaaggaagggatccagtttcagctttctacatatggcaagccagttttcccagcaccatttattaaatagggaatcatttccccatttcctgtttttgtcaggtttgtctaagatcagatagttgtagatatgtggcattatttctgagggctctgttcagttccattggtctatatctctgttttgtaacaaatctgcacgtggtgcacatgtaccctaaaacttaaagtataataaatatatatatatatatatacatttaaggcagaggctggaggatcacttgagcccacatgttcaaggctgaagtgagtcatgatcatgccactgcactccagcctgggccacagagcaataccctgtctcaaaaacagacagacaactttttgcagctcaagtttcaatccttaacaaaaaaatttgaaatggtacaaatcttttctttaccatatacactttatttcaaaatagggctgcagataaattaagaatcattttccaaagaagttatttgagtctcctcttttcaaaaagaaaaagaattaacaaataagttaaactgaaaaaataaaatttaggaaataaagaacaacctataacacatattcaaataaaatgacaaatcagctaatttagaacactatgggtgtgttattcctggaaaccatcaagggaaggacagaaaaccatctgccacaggagatgaataagttgactacttaatctctggacatcacttcccactgcacggtctataaattgctccaactaagctcctcccactttctttataaaactgtgttgtgaatttttggcaaaaagattttagacaaattgtgaaagtcaaattctgtttgacataccaagccacaaactttgaaactgtttcccagcttttaccattgtagattataaaatatcaaaagcagcaagactgtcatatgggcaacattatgtttaagctgtgttaaagttaagcaaaattttgcattgaggaaacatatgtaaaagtgagttataaactgtaaatatatgtgttacatgttcaaatttctttaatatagaaatgtaaaatggatgctttagtttttttcaactatggataaaaatagtatttaatgctaattttttcaggaaataaagtttaaaatggcaaaataaatttttaagggaaggaaatgcagtgtatgatataccaaaaaagcaaataaatttattctttttccagcagtgctattcagaaaatgttatagaagttaaaacctgtttttgaaaataagcaaggcatagaaataaaaaagagaaatgtgaaaaaaataaaagttagccaggcatggtggcaggggcctgtagtctcagctactcaggaggctgaggcaggagaatggcgtgaacatggaaggcggaccttgcagtgagccgagatcatgccactgcactccagcctgggcaacagagccagactccatttctaaaaggaaaaaaagaaaacttgtcaatcccaattatgaataaagttaaaaaaatagaaaaaaataaaaaaattgtaaaaagcatagattttaaaaaaagtgtacagccatgtaataatagtgggggacttcaatacccccactgatggcactagacaaatcattgaggcagaaaatgaacaaagaaactgtgagctaaaactggactctaaaccacatgaacctaatggacacttacagagcattctacccaacacatgaaaaatacacattcttctcatctgtgcatagaatattctcaaaaataaaccatatactagtccacaaggcaagtctcaataaatttttttaaattgaaaccataacaagaattttcttggatcagagtggaataaaactagaaataaatattaaaaggagctctcaaaacaatacaaatccatggaaattaaacaacctgctcctgaacaaacttcatatcaatgatgaagcaaggcagaaattttaaagaaattggaaacaaatggaaatagaaacacagcatctcaaaacttctgatatacagcaaaaacagtgctaagagggaacttaatagggttcaatacctacatcaaaaaagtagaaatatctcaagttgtcaaccgaatgttgtacctcaaggaactagaaaatcaagaacaaacaatagccaaagttaaaagaaaaaaaactacacagatcagaacttggtaaaattgggaccaaaaaaatatgtaaaggatcaatgaaattaaaagttggctctttgaagagatgaacaaaattggtagactgctagatagagtaaccaagaaaaagagagaatattcgtgtaagtataataagaaatgataaaggtgacattacaattgataccacagaaatacaaaagattatcataaactactatgagcatctctacacaaataaactaaaaaacctggaggaaaagtatatatatttctgaaaacatataacatcccaagattgaaccaggaagaaatagaaatgctaaactgaccagtaatgactaattaaacttaaatagtaattttaaaacctcccccagcttgtcaagaaaagccaaagaccagatagatttataattgaattctaccagatgtaaaaaaagtactggtaccaactctatggaagctgttttaaaaaaataaagaagagaatcctcccttactcattctatgaagccaggatcactctgatgccaaagccattcaagggcacatacatacacaaatactacagaccaatatccctgatcaatatctatgcaaaaatctcaataaaataccagcaaaacaaatccaacagcacatcaaaaataaaatgccctacaatcaagtgagttttactacagagatgcaagaatggttaaacatatgcaaatcaataaatgtgattcaccatatcatatgaattaaaaataaaaaccatgtgatgatctcaataaatgcagaaaaggaatttcataaaattcagcatctcttcctgataaaaactctcaaaaaaactaggcatcaaaggaacaaaactcaaaataataaaaattatattcaacaaacccacggccaacagtatactggacaggatactgtttaaagcattcccctttaagaactggaacaagacaaggatgcccactttcaacactcctactcaatacagttagtactagaagtcgtagctagagaactcaggagagacaaataaaacatatccaaattggaaaataagaagttaaattatttctgttgactgataatatgatcaaaaaaccaaaaaaaaaaaaaaaacaaacaccaaagactcctccaaaagactcctagatttcacaaatgacttcattaatgtttcaggatacaaaatcaacatgcaaaaatcagtagcatttttatataccaataacaatcatgctgagaactaaatcaagaagtgaatcctatttacagtagttgcaagaagaataaaatacatacaaataaacttaaccacagaggtgaaagatctccacaaggagaactacaagacactgataacacaatcatcgatgacacaaacaaaaatcctatgctcatggattgtaagaataaatactcttaagatggcaagaaatctatagattcaatgcagtttctatcaaattaccaatgccatttttcaaagaattgggaaaagtcctagaattcatatggaactaaaaatgaccctgaatagccaaggcaatcctaagcaaaaataacaaagctggaggcattacattacctgactttaaattatactccaaggctataataactaaaacagcatgacactgatacaaaaatagacacatagatcaatggaacagaatagagaacccagaaataaagccacatacctataactgactgattctcaacaaaggtgacaaaaatatgcactgagggaaggacaacctattcaataaatgataaattggatagccatatgcagaggaataaatgtggacccatatctctcactatgtaagaaaattaacacaagatggataaaaagacttaaatgtaagtctgaaactataaagatcatagaagaaaacctaagaaaagctcttctggacattggcctgggcaaaaaatttatgaccaagtcctcaaaatcaaacacaacaaaaatatataaaggggacttaataaaattaaatagcttctgcacagcaaaataattaacagaataaacaatttaaaaaatgggagaaaatatttgcagattaagcatctgacaaaaggatagtatgaagaatctacaaggaactcaaataagaaaactaataataaccccatttaaaagtgggaaaaggacataaacaggcacttttccaaaaaacagacatacaagcagaaacaaacatgaaaaagtgcttaacaccactgatcatcagagaaatataaattaaagccacaatgaaattccatcttacaccagtcagactggctattattaaaaagtcaaaaacaacaggaaatatacaatactgctaggaataaaattaataaaacctgcaagaaaaacagagggagatttatcaaagaactaaaaatagtactgccctttgatccagcaatcccactactgggtatccgcccaaagaaaaagacatcattctatcaaaatgacacctgcactatgttctttgcagcactattcacaatagtaaggacacggaatcaaccatcaacagatgatggataaagaaaatgtgagatatatagatagatatcacaaatgtgagatatatatacacatacatacacacacacacacacacacacacaccatggaatggtactcagccataaaaaatgtaatcttgtattttgcagcaatatggatggaactggtggacatgattctaagttacataacccaggaacagaaagccaaatgctacatgttctcactttttttaagtaactaaacagcaaatttttatttagtttttttgttattattatacttcaagttctaggatgcaactgcagaatgtgcaggttttttacacaggtatacacatgtcatggtcatttgctgcacccatcaacccatcatctacattaggtatttctcctaatgctgttcctcccctaacccccaatcccccgacaggccccagtgtgtgatgttcccctctctctgtccatgtgttatcattgttcaactcccacttatgagtgtagatgttctcactttcagtgagagctaaacaatggcatacatggacatacagagtgaaaaagtagacattggaaactccaaaaggtgggagggtgggagaatgttgagagctgaaaaattacttactggatacaatgttcactatgcaggaaatgagtacacttaaagcccagacctcaccactacacaatatatccatggaacaaacctgcccttgtacccttaaaatctatttaaaaaaaaaaaacagaacagttctttgagaaatctccaaaccactctccaaagtagctgagctaatttacattcccgccaacattatgtaagtgttcccatttctctgcagcttcaacagtattatttttactttttatctaaaagttcaaaatattttttaaatgtacaactacaaaaaattggtaaaagcaattttaaaatatctaaataaacagagagatattccaggtccatggatttggagacaggatattgctattattttattctctccacattaataattagagattctgaaaaaactgaaaaacaaagcataacaagttataaaacaagatcaattcacttatcaggcgattatttggggaaaaacaagaatagcatgtgaaaataaatgtcactaactatcctaatcttgataaaatggtaaaagcaccgttcccaaatttcaaaatacataaattggactttatcaaaattaaaaatgcttctgaatcaaagtacactatcaaaaaagtgaaaatcaacccaaagaataggagaaatatttgtaaaatcatatatctgataagagtcttgtttccagaatatataaagaactcttacaactcaacaaaaaaaggtaaacaacccaatttgaaaatacgcaaagaatttgaaaaagacattttccgaatacgatatacatataactaataagcatataaaaataggctaaacatcattggtcattgggaaatgtaaatcaacattgcaatgaaataccacttcacacccagtggatggccataattttttaaatggcaattatccagtgttggcaaggatattgaataattggaaatctactacaattactaaaggaaatgtaaaatctatggatctctgaaaaactgtttggttgttcttcaaaaagttgaacatagaatgaccacctgacccagaaattccactcctatatatataccgaaaagaattaaaaacaggtgtttgaacaaacttgtacacaagagtttatagcagcactactcacaattgtgaaaacaacctaaatttctatcagtctgtatgaatggataaccaaattgtggtatgtccacaataaagtactgatgcatgctacaacatggatgaaacttgaaagcatactaagtgaaagaagacactaaaggttgaaaattgcctaattctatgtatataaaatgtccaaaataagcaaattaataggaacaaaaagcggattagtggttaccagggactggggaaaaggggaaatagaaatgactgttcaactattcggaggcaatgaaaatgttctgcaattagatagttgtaattatcgtaaaacattgtgattgtacccaaagccaattgattatacatttttaaatagtcaaaaaatgaattttttcatataatttttatgttaaagaaatcacaacacaaaaggtattttgaaataaatgaaatttaaagcacaacatatctgaatttcagggaagtaataaaagttctaaaaaggaaatttgggtcacaaagtgtatacattaaaaataaataggccgggcacagtggcttacacttgtaatcccagctactagggaggctgaaacaagagagaatcacttgaccctgggaggcagaggttgcagtgagccaagattcgtgccagtgcactctagcctgggtgacacagcaagactccatctcaaaataaataaattaattaattaaaataatgtctgaaaacaattatcaaaggttttgtactacagaaacagaaaataacaacaaattaagcagaaactaagtagaagataggaaataataaagattagaacaagaatcaatgaaatgtaaattttaaaaatagaaaaatcaatgaaacaaatatctgattattttaaaagatcaataaaattgataaacaattagctgaattaatgtgaaggagcaaaagatggaaagaagtaaggggagagagagagaaaaggcaactcatgtcaataatgaaagtgcatatagccttgcagattccacttaatgatgaacactatccctctaagattgggaacaagacaaggatgtccactcatcatttccattcagctatgaaacctaggtctagcaatataccctaggtttcagccattgcaaaaatataagaaaaggaaataaaagacacacagcttgcaaaggaagaaacaaaattataaaaatacgtttatttgcagatgacataattatgtaggtagaaaatttaaagtattctgcaaaaaactaataggcctaatcagtaagtttagcaaagtaacaggatgtaatgtcaatattttaaaaatcaattgtatttctacaatagcaacaaacaattagaaatggaaattagaaacaaaatactatataaaacattatttaaaacatgaaatttgaggagtaaattataacaatcaattcaaaacctgtatatgaaaagtagaacacactggtcagagaaattaaatacataaataaatggagggatataccatattaataaatagaaaacaataattattttaccatatcattctatattttcaatgcaattccaatcataatttttggagatgttgacaagcttatcctgaaatttatatgcaaatgtgcgaacttaaaaggaactagaatagcaaataattatcaaaaagaagaaagattagttcttactctacctaatttcaagatttagtataatgtaccagtatcaatactgtttggtattggcttaaggataaaaatatagctcactaaaatataacagaatgtccaaaaatacatccaaatatataaatttttaaaagaatgccaaggcaactcaatatttttcaacaaattatgctgagtcaattggatacccataagaaaaaaaaaaaaacttcagccattacctcatataatgcacacacacacaaaaatgaccttaaaatgagttagagatccacatgctaaatctataaaatttctacaagaatttgttttgaccttaaggaaatcctgccatttgtgacaatgtggaaaaacctagaggacactatgctaagtgaaataagccagacacagaaagtcaaacgctgtataatctcacttatatgcagaatctaaagagtcatactcatagaaacagagagaatgatggtagaatgacggttgccagggcctggggaatgagggatatgggaatatatttatcaaagagaacaatctttcatctataagatgaacaggttctgaggatctcatgcacagcatgattagtaatgtatgtgttaattttctgtaataactattacacaatgtacgtctcgatcaaatcaacattttatccaccttggatatataaaatctttgtcaattaaatatttttaaatttaaaaattaaaattaattaaatggtcacaattagtttcatgccctcactgctctagacctcaaggaaccattagcaggtttccagaaaaaggcgtaatgttgatttttttaaaaaagaaaattcctgtgacatgaatcaacagagaaactacatcacaggtcctcacacaagttacgctaccttgctactcaaacagaattcagcattcttaacaacacaggctcagatagagaaagaggactcaaaggattagattccaagtgtaaagaatgaaattccttattcaggaattgtttgttttttttttccaaacatgtctctccagaatactgcttctgtggcaaagtttttccatcaaaggagataattaattcctaggagagaaagcagcagctataaaataagatccctgaatctttacagaaacctctttaaatattcatgcagtgcaagacagaagtgtttttcttgttcactcatccacagcaagattaatcatgggcaaagtgatccatttataactgtttcctccacaccttctgcctcttgcactgtggaaccagagccatatgtaatcaattcttcatggtgtttccagtgaattgattttaattcaagtcccaggttttctgtgaaaatttttgagacttaggccagataaaaagatttatagtcataagaacactttctttattgaattataactgatataccaaaaaactacacatttaatgtgtacagttttttaacaactgtgatttaacattgaatcatctgaataggctctttccatgtgttaaatctttcacaccaaaacttactaattccaaaagaagatcagtttgaagaagattgtgtctgaacactcccaaacatcaagattatctaactaagactactaaggtaagttttctaatagtaccgatgcttcttaaagatagttaatttaagtagtcagtaatcattatttttcaacacctcaaacatagtatatagagtctttcatcctcatcccaatgtttcaaaagatagtaaatataattaacctatttgacagttgaaaattttgagtttcttagaaattcagcaatttgtaggacccagctctctgacaccgggtaccatgcttctgccatgataatcagactagccataaagattaaatatataactaacctgcacattgtgcacatgtaccctaaaacttaaagtataataataaaaaataataataataacaataagcacatgaaatattacctaaatagcattatgaaaagtaacagcatttccaaaacaaaaaactagttagtgagaaaagtggcattgttttaaatttttgccagtgtctggtttagtaaaatacagccagattctcaaaacaaaaaaaaaaaagattaaaacaaaattaaaatacatatcgtatacacaaaggacataaatatgaatactaaattgcataaatcatcagctgtttagtccaagcactaacatgaagaccccttcctgggatcaacagctatggacagtatgagtcactgtggcttcttcaagagtaatgttggagattattcttcctgaggttattgcatggtcaatgatgctctgtttattgctctaatgatcacttcttatgatcccttagctgtgtacacacctgtaaaagtaaagaaagtcctatgtgcatccacagcactgtggtaaacattttcttatatgttccctcaatcaattctcataacagcctgtaagatgatattgttattctcactttatagatgaggaaacaaagatgaaaggtggcaagaaacatgccctggcttaaaaaagttgcaggtggaaaaacaatgattctaatcacatatatttttaattctaaatctaatatacttggccactgtagtagttattttcttttctttttctttttttttttttttctgagacggactctcgctctgttgcccaggctggagtgcagtggcctgatctcggctcactgcaagctctgcctcccgagttcatgccattctcctacctcagcctcccaagtagctgggaccacaagtgcccgccaccatgcacagctaattttttgttgctttttttttttttttgagacagagtttcactctgtcgcccaggctggagtgcagtggcatgatcttggctcactgcaatctccgcctcctgggttcacgccattctcctgcctcagcctcccgaatagctgggactacaggcacctgccaccacaccaggctaattttttgtatttttagtagagaccgagtttcaccatgttagccagggttgtctcgatctcctgacctcgttatcctcccgcctcggcctcccaaagtgctggacttataggcgtgagccaccacgcccggccagtagtcattttcaacattttgttcaagagtctgggggcccacgacttggtggggtgggggtgttgaggaaagagctgggactaggggagaagctaagatagatgtaccttcaatgattcaataccacatttttcttaatatttgaactcaaagatgtcactgtgttgtgggtggggaggggggatacggctaatgaaattgctccatacaaattgcctctgaagtagtattaaagtaagtataatcataatggtcatatcaaaaggagattattagttcaacattgtttattataacataacaacatagggcatgagctcagaatttggagagaaaaaattaactagtataatgtgactaatcttgactctgtcctttattaaactgcttgatcttggatgggatcttcaacttccctatgcttctacttcctaatatgtaaaataagtataaaaatgatagtactattttctgggtttattttgtgattgcctgcaaaaaaacatttagaagacactagtgctcagtatgttttagttaatattatcaatattatgagtgttataatgttaatataaataatattacattattgtataatataaatatcattgtgttaacataactattaacattaatcactaatattgctgccttatctgaaaatttgatgaaataatactggtcacctaggatgttataagtgttcactggaatcatgtgtgcaaagcacttactactatggcttttgcaagacaattaattattaaagggcatataatattagttattataaagttaattagatttagacaataagcattatgaattattttagtagctcttatatcctttttttatacttctttctgtctctctctgtcactctctgtcacccaggctggagtgcagtggtgtgatcttggcctcactgtaatttctgcctcctgagttcaagtaattcccctgcctgagcctcccaaatagctgggaatacaggcaagcaccatcacgcctggttaactttttgtattttagtagagatggggtttcaccatgttggccaggatggtctcgatttcctgacctcgtaatccacccgcctaggcctcctaaagtgctgggattacaggtgtgagccaccggcccagccacccagttacttcttatgtcaagtactctaaatattctgcccactggggttcctttctctggctaacacctgctttgcagaacctcagcccacttcatccaagacatacaaagacttgtactagtgggatactccaagattcctactcctcaaattcctcttcatcttcccactcatattgacagtaacctaccaatgttccccatttcctaaagaataaatggcaaattccttagctttacaccatggcctttaaattcattgtcaatctcccttttcaggtttagctgctaccgtgtatccaatctactacttcaaattgagctcttaggcctcccagatgattgagtatacacacatgacatcctgactttgttcacaagagtttctaatgtcgatactcttcacagagtcttcaccaagtaatcttcaagaactgagaaactttattaacatctcaagaaaaaccttataggaatttacagtttaataaaattcaagcatttattattaaaatggagatatgtaataaattcaaagttgtattaataaaaaatttttac

SEQ ID NO: 587 - DNA, 136374 bp, Homo sapiens
tgcatcctaaaccctataaaataccatttcaggaacaactgggtttttgtctacaagaaattatccctataatagcttgtatatgccgtgaagtaatgagatggttgttaatagaaaaatatttcctagaatagaccatttttattcaaacatctgccaacatgaaaactatgtacacagcattgcaatggagtcatcgctttcctaacagttttcctacagcctgatacccacaccatgtacaacctgactgatacaccatttacagcctgactgactgacgcccacaccatttacagcctgactgactgacacctacaccatttacagcctgactgactgacacccacaccgtttacagcctgactgactgacacccacaccatttacaggctgactgactgacacccacaccatttacagcctgactgactgacacccacaccatttacagcctgactgacacacacaccgtttacagactgactgactgacacacacaccatttatagactgactgacacccacaccatttacagcctgactgactgacacccacaccatttacagcctgactgactgacacccacaccatttacagcctgactgactgacacccacaccatttacagcctgactgacacccacaccatttacagcctgactgactgacacccacaccgtttacagcctgactgactgacacccacaccatttacagcctgactgactgacacccacaccgtttacagcctgactgactgacacccacaccatttacaggctgactgacacccacaccatttacagcctgactgacacccacaccctttacagcctgactgactgacacccacaccatttacagcctgactgactgacacccacaccatttatagcctgactgacacccacaccatttacagcctgactgacacccacaccgtttacagcctgactgacacccacaccatttacagcctgactgactgacacccacaccgtttacagcctgactgactgacacccacaccatttatagcctgactgacacccacaccatttacagcctgactgacacccacaccatttacagcctgactgactgacacccacaccatttacagcctgactgactgacacccacaccatttatagcctgactgacacccacaccatttacagcctgactgactgacacccacaccatttacagcctgactgactgacacccacaccatttacagcctgactgacacccacaccatttatagcctgactgacacccacaccatttacagcctgactgactgacacccacaccatttacagcctgactgacacccacaccatttacagcctgactgacacccacaccgtttacagcctgactgactgacacccacaccatttatagcctgactgacacccacaccatttacagcctgactgactgacacccacaccgtttacagcctgactgactgacacccacaccatttacagcctgactgactgacacccacaccgtttacagcctgactgactgacacccacaccatttacaggctgactgacacccacaccatttacagcctgactgacacccacaccctttacagcctgactgactgacacccacaccatttacagcctgactgactgacacccacaccctttacagcctgactgactgacacccacaccatttacaggctgactgacacccacaccatttacagcctgactgactgacacccacaccatttacagcctgactgacacccacaccatttacagcctgactgactgacacccacaccctttacagcctgactgactgacacccccaccatttacagcctgactgactgacacccacaccctttacagcctgactgactgacacccacaccatttacagcctgactgacacccacaccatttacagcctgactgactgacacccacaccatttacagcctgactgacacccacaccatttacagcctgactgactgacacacacaccatttacagcctgactgactgacacccacaccatttacagcctgactgactgacacccacaccatttaccccttcgtgttggcacatcgaagagcagcatcttagtggtctgagtcacagtgacaaaactttcaggtaggtccaccctttagctgtagatggagcaggtgccccctgcagaagaatctgcctacatcccacgccagaactgggcctcgctccacagacagggaggaggagaaagtgcagccagtttccaaaacaggcataatttagatgtgcccaggctctgatccagatgcaccctgtgctgagactgcagaagctgctgtcatcgacccctcagcaccctactgtgagctttgctccgtaaccactcctgtgacaagcaaacgaattaaatagcgtgaaggatggccaccctggactctgtccacagaggtgccagctgagagtgtgctctgaccgtggcacaccggtccctccgggcactaaaatgagaccctgttcatttcgtgtctcccaccaagcagctgtcaggcgacagtggcttttggtccccgtgtcctgtgagacagtttcaaacaggtggtctatacaggttttaaaaattccctatcccattactggttcccaaagctatccaattccccctccttcttctggggagaatgttgttatgaacagaaaccctgaatcggaggttgcttcttctttcctttctcccacattattcctcagcctcctcagaagacccacgaccaaacacaggaggagtcttccctttggggccgagttgcttcagaaaggctcagagtggctgacaagcttctctgggtacagatgggtgcacaaccatctcagcaaatgccaatgcttttcagcaaataaagcccaaggggtgactggcgatggctttggggctgcagtatgtctatgctggatgactgtttgggggacgcagcccttccctctattcaaagtgctatgtagcttatatttatttaaatgagttaaaacttatcttctttggagacttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcctggctaattttttgtatttttagtagagacagggtttcaccttgttagccaggatgttctcgatctcctgacctcatgatccacctgcctcggcctcccaaagtgctgggattacaggcgtgagccaccgtgcccggccgagacattttaacatagacaagaccatcagactcagaggagaacctgcagaccatctggtccagtgttctagccagggggccacagaatctcccgtgtgctctgagaccgctgacgtgctatggcctcagggggccacggaatctcccgtgtgctctgagaccactgacgtgctctggcctcagggggccacggaatctcccgtgtgctctgagaccactgacgtgctctggcctcagggggcccacggaatctcccgtgtgctctgagaccactgacgtgctatggcctcagggtgccacggaatctcccgtgtgctctgagaccactgacgtgctacggcctcagggggcccggaatctcccatgtgctctgagaccactgatgtgctatggcctcagggtgccacggaatctcccgtgtgctctgagaccactgacgtgctatggcctcgggggcccacagaatctcccgtgtgctctgagaccactgacgtgcatggcctcacggtgacacggaatctcccgtgtgctctgagaccactgacgtgctatggcctcagggggccatggaatctcccgtgtgctctgagaccactgacgtgctacggcctcagggggcccggaatctcccatgtgctctgagaccactgatgtgctatggcctcagggtgccacggaatctcctgtgtgctctgagaccactgacgtgctatggcctcgggggcccacagaatctcccgtgtgctctgagaccactgacgtgcatggcctcacggtgacacggaatctcccgtgtgctctgagaccactgacgtgctatggcctcagggggccatggaatctcccgtgtgctctgagaccactgacgtgctacggcctcagggggcccggaatctcccatgtgctctgagaccactgacgtgctatggcctcagggtgccacggaatctcccgtgtgctctgagaccactgacgtgctacagcctcagggggcccagaatctcccatgtgctctgagaccactgacgtgctatggcctcagggtgccacggaatctcccgtgtgctctgagaccactgacgtgctatggcctcgggggcccacagaatctcccgtgtgctctgagaccactgacgtgctatggcctaagggtgccacggaatctcccgtgtgctctgagaccactgacgtgctatggcctcaggcatggttctggctcggtcagcctgggggctctggtaatgtacactctaaaaaggcatcaggattgattctaatctgtggccatgttgagaactgttgtatagataaaaaagcagaagccaaggtatttgtttaaacatgttttgtgacatatttgggggatgtaacccttggaaaatggcagtcaccctgggattcctggactggtagctgtgggaactcccacgtgccaaaagtgcagccccagactctccaggtaaaatcaaggttctgctgactgttccccaggtaacatgcaatgcactttgtttcctgactgactgtgggtgttagttcactgcaatataacaagcacatattaagaatgtttatgccaggccctctgggaaataccatatttatgtgcacgtatgtacaaatcctcgtgcctgcgttcaggaaggagaggggagaggggtctccccaggcaggcagccagaggacaatgcggcacaggacggtgcaccagcttctgtgctctaagcaggggattctctctctctctgcactggaagataagataaacgcattgcttttaaaatgagccaccctcacgtcctcttcatgcctccgtggtgtaagcacttctaaccagctgtgcttttctcaagccaagaactgagacgcagtttcaggaccagaccttttcactggggcctagaatgtcagctcccacagccacttaaggaaacagaagtatgtgcaacaattttactctgaaggtaaatgaaattcgtgacaagcaggggcacatggaaagttctatgaggattagttcaatcccattggagaatccagaaagatttcatggatgagggaggatttgtactggattttgtttgagaaaaaaagactgcctagccaagttacatagaaggtacttggtaaatgctaaatggaatatcaataaacaagtaagtactgaaccagatcgtggctttgatgtgtaagctcaagatagagtcaacagtacatgtgcatgagtgtgcatgcccgtgtgcacgtgtaaatgagagcatgatctgaacacatgtgtgctggagggtgtgcacgtatgcgtgcatgtgtgtgtgcagatgagtgtgcccgtgtacaaatatgtgtgcatgcctgtgtgtgtgcatgttcttctgcacaggtgacctgccctccctcctttgttgctgcccatagttccagggagtttctgcctcaatccctctctcagtatggtaagcggaaccctgccttcttcttggtagcccactatgccagatttaactgttttatgattaaatatcctccatgcaacattaggaaagtcaggagtcctaaataagtcacgtggtttggcactttaacagctgtgatctcatatgcgcttcacagtaaccctatgcaatggagatcagtcaattaacaattgagttcagctgcctgtcactgaaaagctaaggaactggatgaaaccagatgtcagggtttgcgttctctcacagaacgtgaagtccaaaggaaggcattttggagctggtcaccagggagccagctggggtccaccttgtttagggtctagatgggtggtgtgctggcacatcgtagtgaaaaatagtgctgctttcattttacagatgaaaaactcaggcttccagaggccaggttattttgccccaaatcacacagtgaagaagagctgggtctggaattctaagccagactctacactcaaatctgtttgacccaaagtctgtgcactttcacagaccataggtagacaagcgtgtgtactcacgtggaggaggtgggctcagaagaatcgatggccacggagaccatgttcatgcgtgggccaggaggaatctggagaggctggagccttagactcacttttagtctcgctgtttgactggaataagctgtcctgttcctaatctctgcaagcagactgttctggtgtccccaagatcactccctttgctgtttcaagacaggcaagggctgggtctaggggtcctggcaggtagggcttttccggtctcctgaggtgccaccagctactgtctgctgaggctgctcagatattttcattctaatccttgatagcaggcatagctctgccgtttataaccatcccatccacctgacataggttcttgccgggggcgtttgaattggtgcctctcggtctgatccaacagcccactgcgatgccctggccaagtggcagccctgaaatggtcccattgataggaagggtccagtaccgtctgtgatgctgtgaaaagcatagtgtttctcctcgtttcccagcattcctggaaatatatgaaatacagggcactttatcttgccacaaagttattttaagaaggaaaatcaattttattttattttattttgttttttgagatggagtctggcactgtcacccaggctggagtgcagtggcgtgatcttggctcactgcaacctccgcctcccgggttcaagcgattctcctgcctcagcctcctgagtagctgagattacaggtaccaacgaccacgcccagctaattgttttgtatttttagtagagatgaggtttctctatgttggccaggctggtctcgtactcctaacctcgtgatccacccaccttggcctcccaaagtcctaggattacaggcttgagccaccacacccggccaaaatcaattttaaaaatcctacaaaacacacactgtaaatgccgagatgtatctgtatgtagaccctgaaggttgcactgcgaccacttctgcaaagctgctcactccacctgcctgcctcacctacttcctgcagggctgtgcctgctcctcaattcacatgtccagtttttctgggactctattgaatgccctaattcccatcctttcctagagccctgtctttctaagctatatggctccttctttttcaggccttggagaaggttgaacagatgtcactgaagtcacatccctccttccttcactgacagttccctccgtggctgacacttagtgctgggtgtctcctcccactgccaggaggtacaagctgcctgcaggcttccaccagaggcagctgctgacagacagatgctcacactgccaagggcagagatgctgctcctctgccagctgccccatcttgtctctctgcctgcccaggctctggtgctcacagttgaacttgacaggttcttttccaggctcctcataagactttttccatccaatattcaggccccctttcctccaggagcaaccacaggacccggccacgagctcagctctgtttctgcacctggcagaatgcctgacgtacagcagttgcttgggaaacaaagtttagctggtgagtgaacaaaaaggtgctgcaaggcagtgaccctcctggatctctacacagctgcctgaaacaaaaccctgcatgcaccctgcaagagaattctgaaaacctggagcccaccacacacacacagaaataaaactcctctgcttgtgcccctaagagaattcttaaaactaggaagcacccccattttgaaataaaactctgcttcactccctaagagaattcttataactgggaacctaggaaccccctcctaggtgggttcctagcgtagcatgtggctgaattctacactgtaaatgtgctgagtgcggccgaattctacactgtaaatgtgctgagtgcggccgaattctacactgtaaatgtgctgagtgtggccgaattctacactataaatgtgttacatgtgtctgaattttatcctttgaaatggttaatgttatgtttctttaatttcacctcaataaaaaattcatttaaaaaaatatattgtgaccgtaagccactaattttgtgttttttaaatttttgccatggatccctttggtgatctggtgaaacccatagacctcttctcagaataatgtccttaaatgcagaaagtaaaatacacaagatcaaaaaggaaaacaagtgtaccaaaatacacccatcaaatgagcttaatcatggtacagtcacacatgtgcctctttaacacatcgtgctggtatgatagataccggttttcgtacaaggctcctggctcataactcccacgcctcttgttacagtcttttgttataaccttggctgtgttaggtctcaggggcagcctctgacctcttgccccctttcagattagagttctgtcccaagggaggattctaatcttccctgcctttctggttgtgggtctaagaccctcccatgaagcaagaccccctatagcctgtgggaagtcatgctgatgtcttgaagcttccataaaaaccctagaggactgggatccgggagcttccagagagctgaacatttggaggttcctggagggtgacacccaggaagggcatagaagctctgtgtcccttccctacaccttgacctaccttagaagctctgtgtcccttccctacaccttgacctaccttagaagctctgtgtcccttccctacaccttgacctaccttagaagctctgtgtcccttccctacaccttgacctaccttagaagctctgtgtcccttccctacaccttgacctaccttagaagctctgtgtcccttccctgtaccttgacctaccttagaagctctgtgtcctttcccctatatcttgacctacctgtctcttcatctgtatcctttgcaatagcaatatcctttacaataaatcagttaacgtgtttctctgagttctatgagctcctccagcaaattaatcgaacccaaagagggagccatgggaagcccaacttgaaggcagcctgttggaagttccagaagcctgggcctgtgactggtgcagggggccggcagtcttggggactgagccctcaacctgtgatatctgatgctaactctgggaagatggtgtcagaacaccagagcacactcagctggcatcagctgctaggtgtgtggggaaaaccccacacatttggccacagaaggcttctgtgctgatgactgctgtggtgtgagagcagaggagaaacacggtttgaggagagtttttcccacacacacacattaacaaggtctagtttgttaatcctagtaacaatatgtaagtccagtaactattgcaactttgaagcaatgctaagcagaaacgatgtttcaagttatctgcaacaattataatgtgatagaaactatctctgatttctcttggtgacaaagtcacagacactttaagaccgctaccatttattgcttgcatgtataatggaaggaaatgctaactttcacttagaggttagtgggaaaaaatgtaattttttcattcaagttcatgaacacactaaattaagaatctgaccctattctaaacataagaaatttattctgaattgcacgatcattacatcagtactaacttgttagtaatatatacttgaacaaaagagcatatgtgtgctatacaatttgacaaataaataacattccaagtaaatttatgttaaaatgtatgtcttgatgagatggacgaggttgggagttttttccaatgagtttttctgtgggtggctaatacctattactggaatgatagagagtccagcatcaattattttcctagtgtttatttgtagggctataagcatggaggaaactttgtccacatacagagtttcattgagcaacaggactcaattgtttgaactcctccagagttatatgtcaaaaatcacatggtaggccgggcacggtggctcatgcctgtaatcccagcacattgggaggccaaggtgggcagattgcttaagcccaggagttcaagaatagcctggacaacatggcaaaaccccatttctacaaaaaatacaaaaattagctgggtgtggtggtgagcacctgtagtcccagctactcaggaggctgaggtgggaagactgcccaagcccaggaagcagaagttgcagtgagctgagagtgcaccactggaatccagcctggatgatagaacgaggctctatcgcaacaacaacaacaaaaaaatcacatggacatggtagtatctcatcaagatttatgtgtaatgctctatcagttgacaattcaatttgaacctcctccaattctgataagagaattggaagccaactttcttgggaaaagtttgtttttagttattaaataccacaagacttagcaaatgtccctttattctacctgttcctctttcgctttacgatgctgagtgtccctgtggtcttgtggtgtgtgacgcagagctcaggcctctgttctgttggcatagactgtagaagaggcagcatgggcttggagccggcactcacgggggctggttcctgatccctggatttctttcttgtttttttttttttttattgttacaattttggattttattgtgatcaagatatcaactcattgggcagtttttaatatacaatactcgcatttacattttaaaagtgtaaaatttctgacttccgtattaaggatgagttttaacagggctagtgcagaggcaagcaggtcagtcagaaggttatggcagtaattcaggcagatgaggaggactgacaaatgctaatggaggaggtaatgagcactggttaggtcatagttgttcttcaagttctctgactgttagttttcagaattagggttaattaatctatttgtttatttattttcgtgaggcaggagagtttcaaaaatttaggctttaatttctcttgaaaaattagaaactttggaaacgaattctgtgtctaactgacctcatggaaacaattcaatatagctgactccattatgtgaattctgactgcagcaaaagcatcagctctcttaccaggccgggtctgtggaggtgctactgggtcatttcaggaagttcagcctagatcctgctccttcatccatttcgatgattctggattctcctaatccccgtatgacattcctggctgcttaaactagctgtagtagatgtacatatctgcaaataaaccctgatcaattttaaaaaatgtctatagcctgggttagatgacaagaccccatctcttaaaaacaaaagattcctgtatatgccttgaactgggccctgactgtgtctttccagtggcgagtcttacaccaagactatgaatatggtctctgtcatcaggtgctattgattaacaaatcattctctcagggcctcttttttcttacctataaaatgataggtggtagaatgagttattgttcagtgaacactcactccgaatctcccctccataggagggtcacgtgtccactcctcaggggtgttgggtggacacaggattgcttgggccagtggggcctgggcaggagggaaagtgaaccgtgtctgcacccagctgaaggacagcagcatttctgctccgagctgccccactcccaccccatgagaagaacctgcccgggctccaggctccagatgagacacatggaatagcccaggattctgccataagaccctgagtgagaaatgatgcatgtatatcaccaagcactggggtgatttgggcattatcgtcgcaaaagctggcaaaacctccaagcgtaattttgagaataaaatgagaaaatgcacaggatatgctgacctgtgttctacctaccagagtaagcatcaaacattgtttctgaaaactttctactgatttctgaaagctgactgttggtaattccttttcttccaggttcttctttcatcttctttcatcctttatcaatcacaaaattgtggctgaggtatctggttacagcagctgtgtggaactctgagtgtttcccctcatctcgctcttcctctgccctgacgatccagcaccccacacaacacctggcaaagaggcaaacaaatggcttgggcagctcttccggacaccaaaaggaggggagagtccaggacccaaggggagccccagtggaccctcttcaggcttcatctcctggtcccacatgtagtgttctgttggcagttgaggcagaattgggcactcccaggaaggtgcatgttttcaacagaattctcagaaaactaatgatacacagtcatctaaacatcagttgcatgaacaggggtcagaggaccattccacaatcaaggatgaaaagagcagcaagggcctagccacactcacgaaatgagcaaaacttgtcagggtgttcctaccacccagatcatcacagataagactgtttctccatcaggacgaacagaaatgagacccttaccccaccaggaggaacaggggtgaggcccttcacagcgtcgggatgaacaggggtgaggcccttcacagcgtcgggaggaacaggggtgaggcccttcacagcgtcgggaggaacaggggtgaggcccttcacagcgtcgggaggaacaggggtgaggcccttcacagcgtcgggaggaacaggggtgaggcccttcacagcgtcgggaggaacaggggtgaggcccttcacagcgtcgggaggaacaggggtgaggcccttcacagcgtcgggatgaacaggggtgaggcccttcacagtgtcgagatgaacaggggtgaggcccttcacagtattgggatgactggagctgtacagacttccccagcggttctcagagccttcccatcatcacttagctggtgctgccagggccatccactaatcatggacctatcgaggtctaaactgacacagtcttagacccctcaggtgtctcctcagcttgagacataaaaaccaagtccaggtggttcaggcctcccaggagcatcctgacctgcctgtcattgctgcaggctctctgtggctggttgctctccacccatgaggctttcctcctttgtctaattttatgccttttggatcactgaactattcatagtcttacagtaaaaatctctctaaattatcctgagtaattttatgtactcacaaaccaaagaatagatttgagcactctcccaattattcgcccatccttaggccatggaacatggtaggtttggggaggtgttggtttcttcatgctttctatgtgcgatatcttccagttaatccactctgcctccacactgctcttctgggcctgcctcttcacttgggtgggattttatggcatgccatggcaaacctgaggacagaattcggccttgtcttgtcctgacagctcaggggctgtgcaggtccttgttggcttcctgcaggccctgcctctggtggccgtctgacctgggccgacattggggaccttgataatgttggtgcaaaactgtctagagtcacttccaacgcagatctggaatcttccttcaacagccctttcctactttcctcagtggggacgcaagcagcctctaaaattagaccagtctctttttgggaatttggaagattagagaagaaactggggaaactaaaccttggactggatttgagaaccagagggtcatatttttcaccatatccttttaaggttgaggaaaagagcttacgtatcacaggcctcctcctgtgaaggccctgggctcggatgggtaagctaatacctgggactgtgtgtgtcccaggtgaacatagtcaccatataccctggagccatggaaaacagtcctgtcccccactacctccctgtgaaaaagaagaaatccaacaataaaaccaatgagagtatttgcagctggatcaacagcttgtttcctagtgaaaaagtctcaaggcaacgcagcagaaagaactggagggaagagggcaggccctagccttgagtcagagagagaggaggacagggagaaacaactgaaatgttagatactgacggtttccccaaagcctcctagagggcagcagtgacagaaactgcattccagctgaaggggatcccagaacaggacggtcagccaggcccctgctctttctggcagagtctctgcatagggacattgggctcacagaatgggctcctaacctgagacaaccccaccaggcccttctggctctaagcaatcgccttcactgacttctgcttcaaaaccattcatgctctgaaactgaaaagagagccacttattctggaagacctccagaacaacttggaaaaggttcagagcccagggcctctgagtaccttggcggctagccaggacttggttcacccacttctaaaacggcaggaacacagtggcagggagccacacagactcagtttccctgttgtgtaccaagcatggatctcctcccaccccagcagctacaagcatctggctgttgaataatggaatggcttaacttagttacaccccaaatatctgaatgctcccctaacaggatatcgtatgaacttcgatccagcaaaggttcctcctatagccagagcccaagaatcaaaggagagacgtgaaagtggtctctcttgctgcagtgtctgataacccatgtgaggacctttgctgtgtgtccccttaactttaggctgatttagaggttttggttctcaaaagaagacagaattgttctgatgaattgaagttgaaactgccacctggtcatttcacgctcctcatgctactgaatcaacagacaaagaaaggggttactgtgtgccctgggataattgatcccagttacccgggggaaattgctttgctgctatggaaggagagaagagagactatgtctggaattcagggatatttccagatccaagtaaagatgaatggaaaattaagcaatgtaccaaaggtacaatcacaaaggattcagacccttcagaaatgaaggcttggattacctcacaatgtgaaaaaactccatcaagctgaggtaacagataagggcgaatggaatccaggggggaagaaaagtaggaaaaggaaattattatgcaaaaaaaaaatgaatctaggtacagaccttatacctttctcaaaattaactcaaaatagattatagacctaaacataaaacaaaggctggatgcggtggctcatacctgtaatcctagcactttgggaggccaaggcgggggcattgcctaaactcaggagttcgagaccagcctgggcaatacggtgaaacctcatctctattaaaatacaaaaataaaaaaaaacaaattagctgggagtggtggcgggcgcctgtactcccagctactaggaaggctgaggcaggagaatcgcttgaaaccggaaggcggaagttgcagtgagccaaggtcgcgcaactgcactccagcctggtcgacagagcgagactctgtctaaaaaaaaaaaaaaaaacttccagaagataatgtaggggaaaatactgagaccttaggcttggcaatgagtttgtaaatacaccataataatgatgcgtgaaatgaaatgttggtaagttggactttactaaaattagaagcttctgttttgtgaaagacattctcaagagaatgaaaagacaggcaatggaccgggagaaaatatttgcaaaacacattatggcaaagggcttgtatataatgtacacaaagaactcctcaaactcaacaattaaaaagtaaccttgttaaaaatggggaaaatatctgaacagacccttcactaaagaagatacacagatggcaagtaagtatataaaagatgtgcccagagtttgaggctttagtgagccatgattacaccactgcattgacgcctgggtgactgagaccctctctccaaaaaacaaacaaacaaaagcccaaaacaaataaaagacggtcaataacatacgttatcagggacgtgcagattaaaccaatgaaataccagttcatacctattagaatggccacaatctttaaagtgacgtcaaacactggtgaggatgtgtagaaagaggagctctcattcattgctggtgggaatgcaaaacggtgcagccacttggaaagatagtctgtttcttacaaaacaaagtgttgtcttcacatacaatctggcaatcatgcacctaggtatttactcaaatgagttgaaaaatatgtccacaaaaaaaactgcatacaaatgtttagcagctttattcataattaccaaaaactgcccttcagtaggctagtgggttaacaaactgtggtatatccaatgaaatattattcagccataagaagaaatgagctatgaagccgtgaatacgtggcagaactttaaattcatgtcatgaggtaaaagaaaccagtctgaaaagacaacatcctatatgattccaatgacatgacaatctggaaaagacaaaactatggagacaatgaaaagagcagtggtttctagaggttgagagaaggaggaaaaaatgggcagagcacaggggggtttaggacagtgaagctcttccatagggaagattgggagaaggagggaaaaaatgggcagagcacaggtgggttttaaggcactgaagctcttccatatggtactgtcatgatagataaatgatattcctcaaaacccatagaaatttgcaacaccaagagtgaaccctactgtaaagcatggactttagttaataacaataatgtatcagtatggtttactaattggaacaaatgtaccacactaatgcaaaatgtgaacaataagagaaaatgtgtgtgctgagaggggagtggtgtaatgtgagaactttctgcatatagttcaatttttctataagtctaaaattgttcattaaacataatctattagacaggcatggtggctgacacctgtaatcccagcactttgggaagccaaggcgggcagatcacctgaggtgaggagttcgagactagcctggccaacatagtgaaaccctgtctctactaaaaatacaaaaaattagccaggcatgttggggcacacctgtagccccagctactcaggaggctgagacaggagaatcacttgaacctgggaggcagaggttgcagtgagccaagattgcaccacggcactccagcctgggtgacagagcaagactcagtctaaaaaaaaaatagtctattaatttaaagtaaagaataatgcatcagtgggctgtagaaaaagtctcagatctgatgaaaactataggccatagattcaaaaaactcaacacaactcaagcacaagaaacaaaaaaaataaaccatggtacattataaattacttaaaaccaatgattaaaaagaaaacacaaaaaacagtcaagaaacacacataatgtgcaaaggaacagattagaatggcagccaactcctcgtcagaaataatgcaagacagaaggcagtggatccacatttttcaagtaccaacagaacaacgctgtcaacctagaattccatgcctagcaaaaatatctttcaaaaaacaaagtaaagacatttttaaacatatggaggttgaaggaacttatcaccagcagacctgctctacaaaatttctgtatacctttatatatatttttttcttttctttttttttctttttggcatggtctcgctctgtcacccaggctggagtgcagtggtgcaatcttggctcactgcaacttccacctctcgggaagaatcaagagattctcctgcctcagcctccagagtaggtgggattacaggcatgtgccaccatgcccagctagtttttccacttttagtagaggcagggtttcaccatgttggccaggctagtctcaaactcctgacctcaagtgatccatctgcctcgccctcccaaaatgctgggattacaggcatgagccaccatgcctggccacttttcaatatttttaatacacatataatcatatacaaatatagatacagagacatatttgaccttttgggtcactgtttaacaagcatgtaataattgtatcacttttctgaaaattgcctttctcattcaataatacctgatggacatcccttaatgtcagtgttttcatagatatacaatactctctgatgcgtatattctgtaaattactaaatttctctttaaaaagaatgttattgaggtcagctgtggcccagagataagttacaggataaataaggccatagcagctttgaattttcttccttttggttatgtatgtgtttatatatattattttcctctgctcttttcttccattgttttacgtaataatcactgatggtggttaactttacaacttagcttttagatttagaacatttgggtgggattttgcttggactcaagtgggactttacgtcacactgagatgggtgcagcaactaatggaactgtcatctcgcctttctggctgagcaatgtcattggtacaaattatggctgcgtcttattgggaataagcatgagttgttttgtgtggcagttcaaacacgggtaaaggaaatcaatggaagcgagtaggaggactgtgcctactgtttaccttagtctctcgactcattgtctatattctgttctgtaatgctggggctaaaactacatttctcagtctagtttgtgttgctgtaacagaatatctgagactggataatttacaatgaacagaaattcattttcttaccattacggaggccagggagtccaagatccaggcaacagcatttggcgagggtcgcgttgccgtgtcctttaatgatagaaggcagatgggctgagaagggaggcagggcacagacaagaggggtcaaacttaccctttcatgacaacattaattccgcccatgaggtcggagtccgcatggcctaatcaccctcaaagtttccacctcttaatactgtcacactggcagctcaattttagcacaagttttttggaggggacaaacactcaaaccacagcactctgcaaactgcacttgcaagatagctggcttttattacttgcatttcccttcatagcaggcttcttattaggttctgccaatgggagctcctaggagtttgaaagatgagaagagaggagcgacttcctcatattctcctgtttctgtcaattggctccagccccagttgagtcccacccacttcatgctgagcaccagtgccaaggaaccctgctctgagcactgcttgccttaggttctggtaaccttccctctctttttttgcaccatcatccccagccacggacgggcagcttctttagttcctaatatcggggttgtttcacctcgcattttacccttccagacttccaacacctatgtaaccaattcatctggttaaattccctctgtttgaattaccagtgcagtttttactttcctgtctggaccctgactgacacaaatcccatctcacactgtgaatcttagagcctgagtaacataagcctacttaacaaatgtctgacatcacaacctcaatcagggagctaaaagtcagttagcatggtcctccagtctatagatacagtgaaaagggaatgctcgtgcaacccccgtgacaaacagttcatgccttcttagcccagtactgattgcagtggaattgcattgctgagtacttactgaacatcagctaccacctggcagttacattcacatagagaatgtgagtgtagaagctctatcatccctgtctgccttcaaggtgcttttcacaggggaggtcaatgttctcaacgtgggacaggtgcatgacagagttatgtgcaaaataatttgggaggaagaggaagaaaagatttacaatatctcttccctgcactcactctcagcactcaccacccactcacatactatgcatttgtttactgccataaaatatgggctccatgaaggagcatgttttatctgtttcactcacgaaataattcccagtacgtagcagagtgaccaacacatggtaggtactgaagaaaaattttcaaattaattaatgaaattatcaaacaagtgaacaaaaagatatgcttgaagaggctttgtataatattaatactatatcaataaagtgtgaacaatttaaataacagtatatgataggagccgggcacgatggctcacgcctgtaatcccagcattttgggaggccgaggtggttggatcacctgaggtcaggagttcgagatcagcctggccaacatggtgaaaccccgtctctactaaaacaccaaaaattagctgggcgtagtggtgggcgcctgtaatcccagctactcaggaggctgagacaggagattcgcttgaacctgggagggagaagttgcagtgagccaagatcgtgccattgcactccagcctgggcaacaatagtgaaactctgtctcaaaaaaaaaaaaatatatatatatatatatatatatacacacacacacacacacaggatagattatataacctttggaaatattttgagccatgcatccattaaaaataaaactctgggtggctcgtgcctttaatcccagtctttggaaggctgaaacaggtggatcccttgaacccaagagtttaagatcagcctgggcaacatggtgaagccctgatttacaaaaaataaaaaaatttgccgggcatagtggcatgcacctatagtcccagctactccggttactcagaaggctgaggtgggaaaaatcacttgagcctgggaggtcaagcctgcaatgagccgtgattgagccacggcactccagcctgggcaacggagtgagaccctgtctcaaaaacaaatgaataaaaataaacaaataaatcaacaaaactctaacaatgtgcttgtgcacacaaagttgttcatgatgtaacattttctttattctttctttctttccttctttttttttgagacaaggtcttgctctgtagctcaggctggaatgcaatagtgccatcttggctcgctgcaacctctgcctcctgggctcaagcaattctcatgcctcagcctctctagtagctgagactacagacacatgccaccacgcctggctaatatttgcattttgggtagagacaatgtttcaccatttttccctggctggtctggaactcatgggcttaagtgatctgcccatctttgcctcccaaaatgttaggattacaggtgtgagtgactgtgcctggctgatgtcgcattatttatttatttatttgagacagagtctcgctgtgtcactaggctggagttcagtggcgtgatctcggctcactgcaacctccacctcccatgttcaagccattctcctgcctcagcctcccgagtagctgggactatagacatgccactaagcccagctaacttttgtatttttagtagagacggggtttcaccatgttggccaggctgatctcgaactcctgaccttaggtgatccacccaccttggcttcccgaagtgctgggattacaggcgcgagccactgcacccagccagcattattaagtaaagaaaaaaagctcaaaagaaaagtttgctgtccaaagttcattccttttttctaggaacagcaccaaaacttgtttctaagaaccacctctttccatcttcaccacatggctggtggtttggcttctcaggagtgtccccttgcataagccagtcagcacatcccacccaactggccacatctgtggctatggcacccaattatgaaaaataagattgcaagagtttcctgaggcttctgtaaaaaagaaaatatgtttcttcttaaggagccactcaggatcctctcttgccccgagtggtacagaatgatgacaggtactttgctgccatgtttgatggttggggacagtggacccaacagctcagagagcagagtgaagagaaagagaaaccaactcattcaagccacttattcttgtctcccagaaggtaaccctgctctggagtttcagtttggtaagtctatgcattctattactgcttgggtccagacgaattgagtttcctgtcatttgggattaaaggagtctgggctgatatgcagagcatgattccaacttgattttctaaacatattttaaatatacaatcaaaattttagaagtatcatcaaaacccactattttcacctaccaatccactcctcagtgtccaagcgtttgcttttattcctccaagaaatagctgtggcagccagtgagattcatttatacacaaatggaaagagagtttccagataaatcctgcaagagatcacagtggcttgagcatggtcgtggtggatgcgtgagagagagtgatgcggagtgtgtaggaaaggtcaaaaagaatgttgaagaaaaggttaacagtggttgtcttggttagtatattgctttgtttttctttttacttatttgtattttctaagctttctagaataaacttgtattttctgggtcatatttctgggtctctgccctagctcacaggatggatatcattattgacatgatatcaatataattttaatctcaacctaagataatacagtactctgagttcctaattctgtttggttaagttgcaaattcttagaagttacaacatgactggggggttttgctaaatagactgaacaaagcaagagacacagattgggaggttttgctaaatagactgaacaaagcaagaacctagactctaattccaggttttctgttccactctagcttcagactttactcctaatttttattaatgtgaacatctgagcacaccagaaagaataataagaaccacagagaaagaagagtcctctagaagaatgataatatcttctacatcagaaataggagcactagtattatagcatctggtaaagtcatgaggaaagatcctccaaataagggctgtcccaaactatctgcagttatgctttccaagcttcctggtgttggccccatgtttggggtgtaccaggagagagtgaggggttccaagggaaggccggaggtgctggggatctcaggcatcataagtaacaatgacaaaaacacggatgtgcagaaatcaataagccgagactcactcaggaggctttgagaagccagtcggtgcctatggaccaggctgaacatctgtcaggcaaacaaaaagcaaacagagaagaacaaaggagagtgggattattttcactcaagttcttcttcaggctcagcaggtgacatccaagctgcttggccttccttccttcagacactgaacctccatggagggtatgctgcccagaaaactccaaaccagcaaccccagcacaaaagaaggacgaaaacaaagtgcagatggaaaattcaggcagagccacactgtggccatgtcaaaacttcgcacatcctcgctaatttccacagaaccattttgtttgagtggcagaaccatcaatctccaaggggcgtataagtccagttaatcgaactcttactccaccgctttttcattcttaaggcctgaagttggagaaaaggaggaaagcggagcagccatgggtctttgcaaaacgaacagagctcagagatagcgagatcccaggcacaggcgcagccattagtaacaaaaacagctcacagtggggaagtccatgctatgctacgtgccagcttctcttactgcctttagtcttcacccagctgctatgaggtagattctgctactatccagacctttgtgcacactagagacacgaggtgtcccctggggttgggagtggggctgccacaagtcttccctaatcaacagatgacaaaactgctcaggaattagcccaaattcccacagctggtatgtgactaggttatattgcattacaaacctaccaacaaaattaagatcaccaagtaatatttataaggtggcttgggggtcaagttttatgggttaagtttagacacacccatcacaatgatttttaaatatgtccacaaattctttgatattcttcccttcaaaaggcagtctaattcctttccccttaagcgtggcagtgcttcacaactcacttcatacaaatcgaacatgaagcaatgaagaggtgtcacttgtcataagaaagcatgtgtaccctgctcactttcttgggtcacttgctctgggggaacccagctgccactcaagcagcactatggagagtccttgtggtgagaagctgaaacccccacccagcagccaataccaactggccaggcatgggattcagccattttagaagcagatcttccaaccaggtcaaggtcaaggtcaagccttcagacgacttcagccccagcttcatgacagtgtcctaagagaccctgagcccgaactacccagcaaagctacacttacagactgtgttagaggataactggttattgattaaaccatttaatttggggggtgatttgtcatgcatcagtagataactaagacatccacctttatctaccttatgcctattatgagataccacaattgccaaggctgaaatttaacgtaaatgccctctccctctcggtgaaaccagagactcgcaggcactgtggaatgacaaagctgacaaagctgttccccaaactcacctcactctcccagggcacagctggactgcacttctcagcccccttgcagttgggtgcaatgggactgaggtaccgtcagtggaatatgggccaaagcgtttatactgcttccaagcctgactcataaaaccttcccaggtggcctgctataaactgaatgcaccccagaattcacatgttgaaggcctaatcccggtgtgaccatgtttggagatagggcttttaggaggtaaagttaaatgaggtcaaaagaatagcgccgggagccaataggataggtggccttacaagaagaggaagagaagtgtttctcattccacatgcacacaccaaggaaaggccaagtgaggacacagcaagaaggcagccatctgcaacccaaggagagagccctccccagagcctgaccctgctgatgccttgatctcagacttccagcctccagaactgggagaaaataaattcctgttgtttaagtcacccagtcgtctacggtattttgttacggcagcctgagcagactaagacagatactccatgttccctcttttccaatctgcctgctggatattgagactcaggataaccttggaaatcacacatggaaggtggcagaacccccatcagcttgggtgcctgaatgtctacatggagcagagacctaccaccaccactgctataaccactcatcaggaactcctaccatgagcttcacaagaaagaaacttctattgtgttttgccactaaaagttcaggtttgttcattatggtagctagtattctgtaactaatacctgttacattcattgtgttaattatatcagagtttctttgtatgtatgctaacattagggaattaatttatttcactagtctgtagtttcaactcccgcagactgactcagaaaacaatgatatacaactgcttttggtggggccagtttcttgttcaggataatgcattccagtgcctatatgagcccagggctgtggttttgggggtgcctgtttgactctaatggatgccatcagacaactcttgttcacagggtgggaaatcttcacttttcagtgaaatctttgaatgctgggttagagacaaggcacatgcagggttgtctagtaatgctagaatactaggtattctagtaatgtttgccatgctttctctctttctgaaagatattaatctccttctacatccagggcacattaacacactgtccaaaattcccaaggggaatagaactttctttcccctgtcattgggaaagccaaattttcccatagaattcagtatagtgtttgcttacatggattacggtggttaccatttcctaatccctaacctgcaggtcaaaaatccaggtatatacaaatgcattacttgacttatgtgcctcagttctcttttttttttttttgacacagagtttcactctgtcactcaggctggagtgcagtagtgctatctcagctcactgcaacctccatctcccaggttcaagcaatactcctgcctcagcctcccgagtagctgggattacaggtatgcaccaccatgccaggctaatttttgtattttcagtagagatgcggtttcaccatgttggccagctggtctagaactcctgacctcaggtgatctgcccccctgggcttcacaaagtgctgggattacaggcctgagccactgtgcctcgtcagttttctcatctacacagtgggcataatgatagtatctacctcaaaggagtgttgtgaagattgcgttggataatatgtgtcaatcatggatcatagtgaccaatgcacaatatcagtaagtcatgactattaatgtcactatggtgatagtgaaagtgattgctactacccctgccaaggaataaaagatcccaggctctgggaaaagtcctacatttcattcccatttactggaggagcccccaggacagccctttaacctgggcattggatgccattggcccaggccttcttgcaattctctacctggctactggttctactggccacctcagacctctagcctgtgacagcacagccaccctctccctggcagacatgccactcacaaacagggccccaaggggcccagaggggacagggctctgcaagactcactttcttcccagatgagactgttgaatccaagtaaatggggctgtgctccaggaacttgtgggactcctttgtctagagtcatacacctgagcagcctccctggtcccatgaaggtactactccatcacccacccttaattcctagccctgctctttgtgcctatttctaatgaggaccaggaggtaaggaggagaggagaaggaggtgaggaggagggggggaggagaggaggagaggaggtgaggaggggaggaggaggggaggagaggaggaggaggggaggaggggaggagaggaggaggaggggaggagaggaggaggaggggaggaggggaggagaggaggaggaggggaggaggggaggagaggaggaggaggggaggaggaggggaggaggggaagaggaggggaggaagagaggaggagaggaggagggcaggaggggaagaggaggaggtgaggaggggaagaggaggaggtgaggaggaggggaggagaggaggagaggaggtgaggaggtgaggaggagaggaggaggggaggagaggaggtgaggaggggaggaggagaggaaggtgaggaggatggtggacatgtgagtactgaggctcccggatctcagaatccatgaaaggcggatttgtagctgctcctcttcctcacacctgccagtcaccatgtcctgcagatctgcctcctaagcacctctcaattcaccacttttctccactataactctctttttaatatttatgtatttatttatttattttgagacagggtctcactgtgtttcccaggctggagtgcagtggcgccaccttggctcactgcaacctctgtttccctggttcaagcgattattctgccccagcctcccgagtagctgagattacaggtgcgtgccaacacgcctggctaatttttgtatttttagtagccatggggcctcgccatgttggccaggctggtctcgaactcctgacctcatgatccacccgcctcggcctcctgaagtgctgggattacagtgtgagccaccgcgcccggccgcttttttagaacccagccttggttctgacttggtatctcttcttccagctgaacttgaacaactgctggaatgatggatcaaaatcactagtctcaccactcatccccctgcttgaaatgcttggttggcttcctgaagccttcagaatgaagtccagggctctccatctgccctctcctcattctcctttgcaaaatgttactgatcttcctacagctggggagcttccagctgccacaacaaggccacatgcactgctgagcatagaggttgccagacggctgttcctgctcctgctcttttagtctctcctgctgagccctcagatgctggtgtgcccaggttctttatggctcttctctcttccccaggaatttcacccagacccaagctttaaatctacaacaattcagcacctaaatggctgttttcagtctattaatctgccattcacttcctctttcatttattaaataaatcaccaaagatttatggggtttcttgcataccaggaaagaaagggtaggaaaaaaagaccacatataaagtattgaatagtctaatgaagagaacagaacaatcacataagcaacaacagaaagacactaaatgccataagcaagttacatacaagatctgtggaagttgggagaaggcagaaattgttttatcggtagcatcaggaagggtttcttgaagagggaagttcattcactcagcagaaatttattggacacccactatgtcccaggcacacaggcatttaggagggacccaaaagggtgaatcgaattttgactgggttggaggaactacagaggggtggtgaaaaggaggatggggttggaggaattacagagcggtggtgaagaggaggatggggttggaggaactacagagcggtggtgaaaaggaggatggggttggaggaattacagagcagtggtgaagaggaggatggggttggaggaactacagagcggtggtgaagaggatatggggttggaggaactacagagcggtggcgaaaaggaggatggggttggaggaattacagagcagtggtgaagaggaggatggggttggaggaactacagagcggtggtgaagaggaggatggggttggaggaactacagagtggtggtgaagaggatatggggttggaggaactacagagcggtggtgaaaaggaggatggggttggaggaattacagagcagtggtgaagaggaggatggggttggaggaactacagagtggtggtgaagaggatatggggttggaggaactacagagcggtggcgaaaaggaggatggggttggaggaattacagagcggtggtgaagaggaggatggggttggaggaactacagagcagtggtgaagaggaggatggggttggaggaactacagagcggtggtgaagaggatggggttggaggaactacagagcggtggtaaaaatgaggatggggttggaggaactacagagcggtggtgaagaggaggatggggttggaggaactacagagcggtggtgaagaggaggatggggttggaggaactacagagcggtggtgaagaggatggggttggaggaactacagagcggtggtaaaaatgaggacggggttggaggaactacagagcggtggtgaagaggaggatggggttggaggaactacagagcggtggtgaagaggaggatggggttggaggaactacagagcggtggtgaagaggaggatggggttggaggaactacagaggggtcgtgaaaaggaggatggggttggaggaacaacagagcggtggtaaaaatgaggatggggttggaggaactacagagcggtggtgaagaggaggacggggttggaggaactacagagaggtggtgaagaggaggacggggttggaggaactacagagcggtggtgaagaggaggatggggttggaggaactacagagcggtggtaaaaaggaggatggggttggaggaactacagagcggtggtgaagaggaggatggggttggaggaactacataggggtcgtgaaaaggaggatggggttggaggaactacagagcggtggtgaagaggaggatggggttggaggaactacagagcggtggtgaaaaggaggacggggttggaggaactacagagcggtggtgaagaggaggatggggttggaggaactacagagcggtggtgaagaggaggacggggttggaggaattacagagcggtggtgaagaggaggatggggttggaggaactacagagcggtggtgaagaggaggacggggttggaggaattacagagcggtggtgaaaaggaggacggggttggaggaactacagagcggtggtaaaaatgaggatggggttggaggaactacagagcggtggtgaagaggatggggttggaggaactacagagcggtggtgaagaggatggggttggaggaactacagagcggtggtgaagaggaggacggggttggaggaactacagagcggtggtgaagaggaggatggggttggaggaactacagagcggtggtgaagaggatggggttggaggaactacagagcggtggtgaagaggaggacggggttggaggaactacagagcggtggtgaaaaggaggatggggttggaggaactacagagcggtggtgaagaggaggatggggttggaggaactacagagcggtggtgaaaaggaggatggggttggaggaactacagagcggtggtgaagagggggacggggttggaggaactacagagcggtggtgaaaacgaggatggaggggctgagggaatagtaggtaaggcagccagcaaagtgaattggttctatcttctgacaacagggccctggttgtcctctcagaaactactgcttcctcttcacataactggagaaagctgacctttagtcccagctccaggactgggtcctcagtggcttaagtcaatcagcatttcccatcttcctgatcagagccattacttcagggacaggcttgtagcccagttagaatcaatgatgttataatacacaagaggcaaatacacaaggcaaaccagataaatgaaggaaaacttggattcagtgactggaccaagtctcgcctgaagtcgctttattgtttaagccatttttagttgggtttttctgttacctgtaacctacaaagtcctgtagacacagtgaatcaagatgttgaggcaggaaagcaggggaagtccaagaaactacaggttgttctagaagttaagcaaccaacaggagataaatctgcaaagatagatttttaaatcattgtaataactctttaaatgtaataatagcagctattatttatagtgaccacttatttcatgttaggtattcttttaggttgtatatgttaattgatttacttggtccaatgaaatagatgctaccattatccctcctttttaacagatgtggaaactgaggcattggatagattgacttatccaaggtggcacagttactgaatgacaaagccaagattcacatcctgtctgaactcttaaacattatgctgttgtttgtagttttcagtgaactgtaagaagctaaaagctgtaatcttacaagctttggggtcagattcaacttcttccactttctagctagcatgactttggaaaagaatttaacctctctgagtcccaggttctccatctatgtgacaaaacagagttgctgtctgcaatgaaataatgatggaaagagcccagcaccacagcgagcacacagccaggctccactgccttctcatgttcctgcctcctgctgggccaactcattgtcctggattctgggccggttgggttaacatgaagctcctttcttacctttgttgacctacagtggctaacaaaacccagttgcagacccgggaggagcaagaagcactttccttttatgtctgcagccctaagtaatcctcctcccagagtctcccagagaggagagactgtcagctgtgcccctccccttaagcccactgctctgtttggctcttgctcatagacatatggcaggggctttgtcttcaaatatgtctgctttcaagttgaatacaaccattgtctgagcctgggccctccaggaatttactgatgagggcaggttgatgacggcacagaatttcagttgaaactttccagttggctggttgtcagcagctgagatggccagggagctgacctgggcgagattcccaaactacccctcttttttttttttttttttttgagatggagacttgctttgtcgcccaggctggagtacagtggctggatctctgctcactgcaacctccacctcctgggttcaagagattctcctgcctcagcctcccaagtagctggactacaggtacgtgccaccacacctggctaatttttgtctatttagtagagacagggtttcgtcattttagccaggctggtcttgaactcctgacctcaggtgatctgcccacctcggcctcccaaagtgctgggattacaggtgtgagacaccacacctggcctgaactgcccctcttgtgaggaaggtcctggacactgtcccccacctagtctgaagaccctcttggacatgtggaggcccagggcatggctgtaaggctggggagtggagttggggtagcccacagctaacatgcgtgaacagaatgaagggggtagcaaagcaggcaggacccactgcatggctgccccagggcctgagtgaccaggacaccccaggtgaaacagagtggaatcttgctgcgggccttcctctaactttttgttctcgaatagtctttgagatttatagggtagttgcaaagatagtacagagtttctatatatcctccacccagcttcgctaatgtcaaaattctgtgtaaccttggtacatgtaccaaaactaagaaataacattggttctgtgagtccatagatggtaattaataaacaaataaatacaattaaaataaataaaaattagcatagacacgtgtcaaaactaagaatgaacattggcatatgtatcaaaaccaagaatgaacattggcacgtgtatgaaaactaagagtttatgttgacatttgtatcaaaactaagaattaacattagcacatgtatcaaaactagcagttaacattggcacatcaccactactaagctccagaccatattcagatttcacccgttcttttgccccaggacacatccaggaccctgtgctgcatttagttgttatgccttctcaggtactctggtctgtgacagttcctcagtctttccttgaatatcccgtgaattgggtttgtctgttgtttcctcatgattagattgaggttgtgggctttggggaagaatgtgagctgcccttcccaggatagcaatgtgacttgggtgatgttagccttcatctcctggttgaggtgggtctgccaggtttctccactgtaagtaactagtttttctatttaacattctgttctaaagccactaaatccagcccacactcagggttggcgtggagagggagcgaggaaggactcacatgtattgtttggagtgcagaggcttttgaaagcaaaagatgtctgttttgggtgccccagctcagaccactgctttagagagagtttccatgaggcttggggcccttctgtgggctcacgtttcttcagaacagctaattctgaactttggcaatcctgatttgagcactgtagtgccaccggagagctaatgagagacagacagagaaggtatggcacgtggagccatcccctaccctcccccggagggcgtaccatagtgtgagtggaaaagcctgttctccaaagcaccttccctgctgggcccggctaacacaggccctcagcccactccagatccctccctgctggcattccctgaaatctgtccctgaccgtcaacccctcaggaaggtggcccttccctacaagacccaaagacccctgcatgacacttaaggccttccaggaagcctcctggcctgtaggcccttgagacccccactggaccctccctttctgtcctgttttgttttctgactaagcttatctctcagttgtggaactgcagtgctacctggggtgggatgagggtcccaatgagagaagggtctgaaaaccttaaccacccagagtgggctctctggggtgggatgagggtcccgatgagagaggggtctgaaacccttaaccaggagtgttttcttctggcctcttggtattatatttgtctcctcagtcacacccccctgcccctgctgtttctgaaactccctgccccagtggttctagttctggtcttggatgactccccactgtctgctcactgatggaaccagatgcctcactttctgcctgtggttcctggtgtcgctttgtcttctcaggcacttccatgaccaaatcaacaagtctccctcaaaaaccatgtggtgtgagcagctgaggctcagagacaagagatcacctgtcccatgtcacatggccatgtagccccaatgcttttctgcacaggtaggagagctggacccatgcattcactccacaagcatttactgaacactactaaatgccaggctcccatctactagatcagaacagagaatgtccggcccaaaaagaacaagcccatgaccaaaaagcaggcattggcaaagcagagtagtactgacctctctgaggaaccgtcatttcccagagccaaagggaatgagaggcatgtcccatggccatcaggagagggaaatgagggatatgtcccacggccatcaggagagggaaataaggagtatgtcctgtagccattaggggaagaaaaagaggggcatgcactgcagccttcaggaaaaggaaatgagaggcatgtcctgcagccatcagggaagaaaaagaggggcatgcactgcagccatcaggggaaggaaatgagaggcgtgtcctgcagccatcaggggaaggaaatgagaggcgtgtcctgcagccatcaggggaaggaaatgagggacatgtcccacagccatcaggagagggaaatgagaagtatgtcctgcagccatcaggagagggaaatgaggagtatgtcttgcagccaccaggggaaggaaatgaggggcatgtcccacggccatcaggggaaggaaatgagggacatgtcccatcccagagccaaagggaatgagaggcatgtcccacagacatcaggggaaggaaatgagggacatgtcccacagctatcaggagagggaaatgaggagtatgtcctgcagccaccaggggaagaaaaagaggggcatgcactgcagccatcaggggaaggaaatgagaggcatgtcctgcagccatcaggggaaggaaatgaggaacatgtcctgtagccatctgaggaaggaaataagagacatgtcctgcagccatcaggggaaggaaatgagggccatgttctgcagccatcaagggaacgaaatgagggatgtgttctgcagccatcgggggaaagaaatgagggacatgtcctgtacccatcaggggagggaaatgagaggcatatcccgcaaccatcaggggaaggaaatgagggacgtgttctgcagccatcaggggaaggaaatgagggacatgttctgcagccatcaagggaacgaaatgagggatgtgttctgcagccatcaggggaaagaaatgagggacatgtcctgtacccatcaggggagggaaatgagaggcatatcacgcaaccatcaggggaaggaaatgagggacgtgttctgcagccgtcaggggaaggagatgaggggcatgtcccacagccatcagggaaaggaaatgagggacatgttctgcagccatcaggagaagggactgaggagcatgtcctccagctgtcaggggaaggaaataagggaactgtcctgcggccaccaggggaaggaaatgagggacatgttctgccactgtcaggggatgaaaatgagggatatgttctgcagccatcaggggaagggaatgaggggcatgtctcacagcaggggaaggaaaaaagaggcatgtcccacagccatcaggggaaggaaatgagggacatgttctgcagccatgtggggaaggaaatgagcgacatgttctgccaccgccaggggatgaaaatgagggacatgttctgcagccatcaggggaagggaatgaggggcatgtcctacagccatctggggaaggaaatgagggacatgttctgcagccatctggggaaggaaaagagggacatgttctgccaccatcaggggatgaaaatgagggacatgttctgcagccatcaggggaaggaaatgaggaacatgtcctgcagccatcaggggaaggaaaggaggggcatgtcctgcagccatcaggggaaggaaaggagggacatgttctgcagccatcaggggatgaaaatgagggacacgttctgcagccatcaggggaaggaaatgagggacatgttctgcagccatcaagggaaggaaatgaggaacatgtcctgcagccatcaggggaaggaaaggaggggcatgtcctgcagccatcagggggaggaaatgagggacatgttgtgcagccatcaggagaagggaatgaggggcatgttctgcagccatcagggggaggaaatgagggacatgttgtgcagccatcaggagaagggaatgaggggcatgttctgcagccatcaggggaaggaaatgaggaacatgtcctgcagccatcaggggaaggaaagtaggggcatgtcccgcagccatcaaggaaaggaaataagggacatgttctgcagccatcaggggaagggagtgaggggcatgttctgcagccatcaggggaaggaaatgaggaacatgtcctgcagccatcaggggaaggaaatgaggggcatgtcccacagccatcaggggaaggaaaggaagggcatgttctgtagccatcagggaaaggaaatgagagacatgttctgcagccatcaggagaagggaatgaggggcatgttctgcagccatgagagaaaggaaatgaggggaatgtactgcagctatctgggtaaaataataagggtcacatctggcagccatctgggggaaagggataggatatgtcctgcagccatctgggaaaaggaataagaggcatgtcctgcaaccaacttgggatgggaatgaggagtatatcctgcagccatcggggaagggaatgaaggtcacatcctgaagccatctgggaaagggaatgaagggcatgccctgcagcaatgaggggtacatcctgcagccattggggcatagaaatgagggggcatgtcctgcacccattaagggaagagaatcagtggcatgtcctgctcccactaggggaagggaatgatgggcacatcctgcagccatcaggggaagggaatgatgggcacatcctgcagccatcaggggaagggaatgatgggcatgtcctgcagccatcaggggaagggaatgatgggcatgtcctgcacccatcaggggaagggaatgatgggcatgtcctgcatctatcatgagaagggactgatgggcatgtcctgcacccatcaggggaagggaatggtgggcacattctgccctcattaaggcaagggaatgagtggcatgtcctgcctccactaggggaaaggaacgatgggcccatcctgcagccatcaggagaagggactgaccggtatgtcttgcacccatcaggaaaagggaatgatgggcacattctgcccccattaaggaaagggaatgagtggtatgttccacacccatcaggaaaagggaacgatgggcccatcctgcagccatcaggagaagggactgactggtatgtcttgcacccatcaggaaaagggaatgatgggcacattctgcccccattaaggaaagggaatgagtggtatgttccacacccatcaggggaagggaatgaggggcatgtcctgcagccttctggggaagggaatgtgggtcacatcctgcagccatcaggggaagggaatgaagggtacatcctgcagctgtctggagaaggaaattaaatgcaagtcctgcagccacctgggaaggggagttggaatgagtcctaggtcaccaaacagcaggcatcaagcttgtccagctcccctccagtcttccaagcaagccacagaagctggtgtcccacaggaagccacagaagctggtgtcccacaggcctatggagtttccagggaggacctctgctgatctagaaggtggcttcctgcctgctgagtgggaaatcaaggctgcccttcttggtcaggctctctgagcacatgcatcatttaccagagcaccagcgaaaagcagagcaggaggcacgagagacctgcaagtgctctggacagggagtaagattttcttctgatctcatgaagcttaatggaaaagcaaacacttgaaaattattttctaacccacatacaccacagcaagggaacacattggcttctacaagtgtctagttggtgtgacttcctgagatatggtaccaacgtcgtaactcactggagaatattcagaggccccctgaagggagggaacaagatcctttctgctcttatgcttaaacctcttctccctcaccatcattgcactgtgtctgtgaacatctgatcaccaggaaaatatggccctggattaagtccctaatggtcaaattctttaggcaatttttcccctttaaaataattaactgtattaaagaatctgaaaaacagtaaacagttctggacatgtggcctgtggaggatgaaagaaatgaaggttccttctactggggaggcttttggagactaccctgaaattggaacacatcgagtatctggaaggaagaccctaaggctcctgcattttgcatgttgatggccgttgtgttatgacgtttttttctgctcacttccttttgtttctggaggtttgtgcacccctgtggccctgggatcagtgaaggaacagatctctggagtttccaagttcttttctaaccatccttagctttattgagctagggacacaaaaggacaaggcgatgggagcaggagctcatctgtgcacattaacttcttgcccagtgaaggccccaaagcaaagtttagccccacactgatgtgaggaaacctaatttcacccacaaagagcccatggccagctgacaggtcagggagggtttgtcttgctgtgcatggaggatcctgccagaggcgtccggctgaggttgtctctcttcagtgacgtgatcagacacctaaggattcagggcaggtgccaagccctgctgccccagttggctgatgcctgacgtcttcacgatgacgctggcatgcggccaacaaggagcactcggggacataattcataagagagcagcatgcatctatgttgacagaatcggagcactctgctcttcccagtctcttcaggtttaaaagggtctctccccattaaagtcttatttgaagtctagactttagtctaaacttatatataaagattttaaaggtttgtttgaagtatagataaagtataactgtaagctcatgggacctgctgctggagagtggaatggaatggagatttctcacaaatgagaatcagctctgggtcagaactcccaccatggtagcttgagcccactctctagactgacagcagcaggaggaggcaatactggaagaaaaaaaagggaggaatgagctcctcactcggtagcaatacaacaatactgaaggtattattatttgtacatcaattgaaaagaataggaaaaggagactgactagttgcttaaattcaatagttttctatgctatggcacaccagaaaatatcccagatgaattaaaagactcactttttaaaacctagtgaaaacagagaattatattttattagtatagtttgaagaaagccttcaacctatactaataaaatatagaagaaacaaacccaggagtaacaaaggaaaatactggcaaacttcatcacatacacacttaaaaccaccctatgagaaaagcccacataaatgaagtttcttttaaggtgtctacttgaataaaatatttgcaaagtatttaagaggttaaaaattaatatgaataatatataaatgaattattcaaactgacaagaaaaagacaactcaacagaaaaatgggcaaaaaaaaaaaccacaggcaattcatagaagacagacaagatacaaatatatacacaaacatacacatacacatttattttccaacctcctcctcaactgttagtaaggggaaggcaagtttgagcaaaataaacaagtatgctcattacttatagtagctgtgttttgtaaagtcactgctgtcaactgaagaatcacgaggttcatacatttggagaggagagctttatttctgacaaaggattgcaccctgcaggctggccatcttgcaggctaggaagcagaaaccaaaagcaggcactttgagggcggaaaggctggaacagggatttatgccaaatgggttggctaagtacatgtatctaacaggttattcatgatggatggatgcatgcatagagagcaaacatgcatgcatgtccgtccacattcaatctggggtgagcacttaacgtttaaatgcactaaaattaggtctgtatgtagaagatgaaatggagggcgcagaggcatcccgtgtgcagccactgtacaccggccagaagcagtccacggtcggtggtctcttatcaggaaggaatgccggttcgtcactgtgtcaaaaccacggaaggggagtctggcaagtctttggaaagggctgtggcttctgattgaccctcgcgtaaggaagtctaatggcgattagcgagggagggggtataacaaggcgtgtccaaactccccattccatcatggccaggaactcagcttttaaaatttctctggcgcccccttggccaacaaggagtccattcagtcagctcaggggcttaggatgtcatttttctttttcagcacgaacattgaattagtgaacagtgaaccatcgctcatggaggaaagaccgcgttaggttcccgtgagcctcaggacacagcatcaccccatcaatatacaaccttgttttatgtatgtttctgtttaaagacaccttacttagtatatattgtagagtaagtaacatgaccaacggcactgtaactcatgtctgaatgaagcttatctaatgcgtgttttctccgaaaggcacctcacagccttcttgctctcaggaacgctaagcagcacttccgcactgtgcttgaggctattttaaacagtgaaatcaccaacaaaaagcataaaaatgcggcgaaaaaagtggcactaaataaactgtgaatgtagtcccagctacaagggaggctgagggttcatgccgggaggcggagcttgcggtgaggcaagactgcgccactgcactctggcctgggccaaagagcgagactccgtctcaaaaaataaaataaaataaaaaataaaaaataaactgtgaaaagaaaacagttgcttacagtatgagttaaaaccagaaggccgagcatcacctcattcagctgggagcatgtgcactgaagacaaactttcgcctcattcagctgggagcatgtgcactgaagacaaactttcactcattcagctggaagcatgtgctctgaagacaaactttcactcattcaactggaagcatgtgcactgaagacaaactttcacctcattcatcttggagcatgtgcactggagataaactttcactcattcagctggaagcatgtgctctgaagacaaactttcccctcattcagctgggagcatgtgcactgaagacaaactttcactcattcagctggaagcatgtgcactgaagacaaactttcactcattcagctgggagcatgtgctctgaagacaaactttcgcctcattcatctgggaacatgtgcactgaagacaaactttcactcattcagctgggagcatgtgctctgaagacaaactttcactcattcagctggaagcatgtgcactgaagacaaactttcgcctcattcatctgggagcatgtgcactgaagacaaactttcactcattcagctgggagcatgtgctctgaagacaaactttcactcattcagctggaagcatgtgctctgaagacaaactttcactcattcagctggaagcatgtgctctgaagacaaactcactcattcagctggaagcatgtgctctgaagacaaactttcactcattcagctggaagcatgtgctctgaagacaaactttcactcattcagctggaagcatgtgctctgaagacaaactttcccctcattcagctgggagcatgtgcactgaagacaaactttcactcattcagctgggagcatgtgcactgaagacaaactttcactcattcagctgggagcatgtgcactgaagacaaactttcgcctcattcatctgggagcatgtgcactgaagacaaactttcactcattcagctgggagcatgtgctctgaagacaaactttcactcattcagctggaagcatgtgcactgaagacaaactttcgcctcattcatctgggagcatgtgcactgaagacaaactttcactcattcagctggaagcatgtgctctgaagacaaactttcactcattcagctggaagcatgtgctctgaagacaaactttcactcattcagctggaagcatgtgcactgaagacaaactttcactcattcagctggaagcatgtgctctgaagacaaactttcgcctcattcatctgggagcatgtgctctgaagacaaactttcgcctcattcatctgggagcatgtgctctgaagacaaactttcgcctcattcagctgggagcatgtgcactgaagacaaactttcactcattcagctgggagcatgtgcactgaagacaaactttcactcattcagctgggagcatgtgctctgaagacaaacttttactcattcagctggaagcatgtgcactgaagacaaactttcacctcattcatcttggagcatgtgcactgaagacaaactttcactcattcagctggaagcatgtgcactgaagacaaactttcacctcattcagctggaagcatgtgctctgaagacaaactttcactcattcatctgggagcatgtgcactgaagacaaactttcgcctcattcagctgggagcatgtgcactgaagacaaactttcactcattcagctggaagcatgtgctctgaagacaaactttcactcattcagctggaagcatgtgctctgaagacaaactttcacctcattcatcttggagcatgtgctctgaagacaaactttcgcctcattcagctggaagcatgtgctctgaagacaaactttcactcattcagctggaagcatgtgctctgaagacaaactttcacctcattcatcttggagcatgtgctctgaagacaaactttcgcctcattcagctggaagcatgtgctctgaagacaaactttcacctcatgcagctgggggcatgtgctctgaagacacaaacttttcacttctctgtgcacttgagagggttgatttgagggttaccaataaatgttggtgagtaggtagattcacaaataagaaatccatgaataatgagggtcaactagagagagagggaaagacctcgcgtgtggagagaaaaaaaatgtgaatatttgcaccccaaagcttgcccagtagaagctgtcagccctttactgcgcttctcccttacatcatgtttgtttcaagcactggggcagaaacactgagaccacgttgctgcctcagagggtttattataatggaggagtcagattatactcaagtgaacaaataattacaggttgtgctttttctagaacaaaataatcaggttgctctgaaaaagaatactcaggctagctgagagagatgtaacctgtgctggagaactgagggaagccgttgccaacagtgtggagaagggagagggggccaggctgccagcagcctgtggcacggtggctggagaagccagctatgggcctatttggttctggggagagtagtggggctgtatgtgagtggttagtggaattttcactctttatataactgtggggtatttttaatgaaaatattaatatatttacattgcagagtataaatgaaaatatttaaaataacaaagcaaagcattttccagtttctttaagggtggcctcgtggtccttattgacataatagggagagcttgttagctgtccatctctcatctggacaccacagcagcctctgtaccattatcactcttactagcactatcctggaccactccccacagcaaccaggataacagctggctgtgtggctcctttctctgactgtcttgtggtcttgagataaaaggtcatcatctgtcacatgctccccaaggcccaaaaggagctgcctctgcaagccttccccactcactgcgcgttcacgccgtgggagctgcacgcgctcactctgctccgctgcgcgttcacgccgtgtgagctgcgggcgctccctctgctctgctgcgcgttcacgccgtgtgagctgcgtgtgctcactctgccctgctgcatgcgtggctttctctgctctgcattcttgtctggcaccctctcctgggggccccttccctgtcacttctcctgctcttcccaaagcagtcaacggaaaattgactatttatacacaagtgcccagttacagattggtgtaagcctttgatccatcttaatcagcagccataaaaaagaatgaaatcacatcctttgcaacaacatggatgcagctggaggccactatgctaagtgaactaactcagaaagagaaaatcaaacactgcttgttcttgattataaatgggagctaacaacaatgggtacacatggacatagagatggaaataatagacactgggagctccaaaagttgggaggttgggaggggagtgagtgttgaaaaattagctgtcagttacaatgttcactatttgggtaatgggcacactacaagccctgtgcccgccagcatgcagtatacccatgtgacaaacatgcacatgttcctcaatctaaaataaaaccaatgcaaatgcacgccgacatgtgattgactaacttattctactagactgtgggctatatcacttgaggtctgtcatttgtactgtggggtttacatcaatgatagaatctttaactttctagttcaacacttttaccaaagcaacatactttcacaagtttgacagtctcaaattattgccaaaattttgccacccagactcggatttcagaatatgtctgaattcatacattcattaccaaaattgtagatatatattaacatcatgggaaactgagaaaaattatagctcagtcatttcctcttgaaactaagctttacaaaaagagaaaaatttgagttcaaatctaatctaaaatttgaattcaaatggcagctggcaaaaatcgagttttcttagctctaagaatctcttcttatactacgactacaatgcttgaaatgtgcaacctctttgagctggggcagtctggctatggagacagggcagtctccactctacctgtcccgaacactggatcatgtgcggcctcatcacctgcattctgatggccagtgagcatcactctcattttcctgcaggtgcggtgggggttgtgggtacttcgcatcctcagtaagagaagaccatgtatgaactatgaagccaatgatcattgagacctccaatacctttcattctaaaaagtccttaagaaggtgggatcagttaggcaagaaaataccgccacaacacaaaagtttagacgtgtgaaacagtgaaggaacttgagtgttagagttacaaatagtttgttaagaatatttattgaatgcctattatacacttgatactatgtagatgctgggaatacactgatatatggaacacatagtttcttcccacatggaatttatcatctattgtccgagagagatcaaggaaattaaaaactaataaaaatgcaaatggagtaatgttataaaggagacaaacaggctaggccacagtgaacaatggagtatggaacctatttcttcttaaaaggaggactaggaaggttgctctttggaggcgcaacaagtactgacaggtgagaatgaggagccatgcatgaatgagcatgcaaggttgacacaccaaactggccaaagccactgagagaaaataactctataggttcaagggaaaaaatgaggtcaggggagctggaggacggtggtcagtgggagaggggcatgaaatgagggaggagaggcggctgagggggaaacacacacagagaccacacatgcattaactacctgcaggagggacacacacacacacgcaaaaaccacatatggatgattcacctggaggggatgcacacacagagaccacatgtggatgagccatgtggagggtacacacacacacaggggccgcacatggacaacccatgtggatgagcaacacaacacaatggagaaattggtatgattccatatgctttaagaaggtcattctggctgtttggtgagattggtgggggaatagctagataaattagtgcagtggctatccgaatggcccagacctgtgcagatgataagttaaatgatggttactgaagacgacaagatgtggttgagtctgagatatgtatggtaggtagaactgacaagatctgtactggactagatgtaaggaatgaaaggaaagccattcaggtctatagtgtgagcaactgatgaaagggcacatgaagaagactcctggatgaacagattgtaggaaaagctggataccaacattcactttgggacatgtttctattggagaatctcagtagtgatgttatagtcattgaatattttagtctaggattcaaaggataggtttagtccagaaatataaatttaggactgatcagcatatagatgacatttagtatcatggggctggttgaaaagctagggagagagtggaaggagactgagccttgagaaatggccacaactagaagttggctagagaaaaagaaagtgtacagaaaactgagtagcagctaatgaaacgggagaaaacttcagagaatgtggcatcaccaaagctaagagaatagactgtttcaatcaagagaattatcatgctatttggccacaaggagatcacttgtaccttgacaagatcattttagtgtagtggggacaaaagccagatcagaaagcaggaaaggatggaaagaagtgggatcagcatttatagacaacatttatgagaggtttgactatgaaaagaattagctagagggtacaatagctagagggtaattagggaacaagggaggctctcttatttctttataatgggaggtaataaagcatattagttactggtgaggatgattaaatactaatgaaagatcaatagcacacaacagaaaggaaaagaaagaagttctagacaatgaccccatgagagggaatgggatcaaaatctcctgtgaagggtttgatttttgttagtaggggagaccttctccagttttatctggatggaataaagagcaaaaggtgcaggtagaattacagatttgggagtgagaatacgaaggaggtctattatgatattataacttgtttcagtagagtatcaagctatatggacagtacttaagtgaaagatgaagctgaaaagataggcaggggttatatcatacagggccttacctgccatggtaaggagtgttttaggtgctaggaagctttttaaaaaccaatgaaggtataataataagaaaacaaatgacccattataaaaatgatttaaaacataattagtcattagggaaatacaaattgaaaccacaatgtaatattactgtacacctagcaaaatggctttaataaaactctgacaatgtcacatgttgatgggagagtgaaacaacaaggactgctaacactggcagatatattaattattatatgacaacgattttagaccaaccatcataaaaacacttcaggctgggcatggtggctcacagctgtaatcccagtactttgggaggccaaggcgggcagatcacttgaggtcaggagttcaagaccagcctggccaacatggtgaaaccccatctctactaaaaatacaaaaattagccaggcatagtggcacgtgctactcaggaggctgagacgagaatcacttgaacccaggaggtggagattgcagtgagccgagatcacgacactgcactccagcctgggtgactgggcaagactctgtctcaaaaaaataaatacataaaataaaataaaaataaataaaaaaacttcaacaagcaatacaaaaacacttgaaatatattagaaaaatagaaagttccagcaaataattagaggatattaagaataactgaatggaaattttagaactgagacatgcaataacaacaaaggtttttaaaactcagtagatggactcaacagcagaatggaggggacagaggaaagaattggtgaacagggaattaaaacagggaaataaaataaaataaaaaaagaaattacctaatctgaactgcagaaagaaataaacagagccttggagacctacaggatcacaatcaaaggtctaacatttatgttattggagtcccagagagaggagaaagagggcatgacttaaaaagtagtcaaacaaatagtggatgaatattttctaaatctggcaaaagacataaatctacagattcaaaatgttgagtgaactccaaataggataaacccaaagaaatccatgccaaagcatgctataactaaacttttgaaaactaaagacaaagaaaaaatattgaaagcaatgagagaaataacatctacctataagggaaaacaatttgaatgatacggaatttctcatcagaaaccagggagccagaaggaagtaacaacatttttcaagtgctcaaacaaaagaattgtcaacccaggattatttattcagagaaaatataaaggtgaatgaaggggacttgaagatattttcagatgaaagaacagtgtaagagaatttgttgccagccgacctcctctaaaataatggctaagggaagttttctaaacagataagaactaataaaagaaagaatcttggatcatgttaacctaaaggaaaaaaactgaggcaaaattaatataagtagagagtttatctgggctgaagctgaggactgaagcccaggagactcatgcaagttgccttgatccatgctccaattaacagtaactacaagtggtttgtaaaagcaaaaaagaagtgcagtccttaagttgtttaccaataatttactttgctttattaaaataacaaaagtgattggttggctatacatttttctttgtatcacaaattccatgaacatgaagattatggatgagagttacattgtgcaacttgtggtaacattttaggtaatttatcagctagcctggaaactagaagaaagggaaaaaaaatcaaaatgcctttaaaaacttgcccccaggtatggctgcagaggacatgattagagtctcatgtttatgtctctctgcgtctgatacattttccatatcaggccaggcatggtgtttcatgcctataatcctagcactttcggaggctgaggtgagagggtcacttgagaatgggagttcaagaccgccctgggcaacacagtaagatcaagatcctgtctccacgaaagaaagaaaaaaagaaaagaaggaaagattgatttaaaaattacttgacatgacggtgcatgtctgtagtcctggttacgcaggaggctggggcaggaggaccacttgagcccatgagttcaaggctgtaataagttatgatcatgccactgtactccactacagtgtgggtgacagagtaaggccctgtctctctcaaaaaaaaaattcatatctcacattcctcagacgctctgagacatgttctcaatcattaggaaaaaagaaagaacaaggaaaatagtaaaaatatagattaaaaaatacattttccttctcctcttgaatattctaaattatgtttgatagttgaagcaaaaattataaccctaactgatgtggttgtaaatacacatggaggaaatatttcagacaattacattaaacatattattaatatcaaatatttatgattattaaattataaatgaggagggtgaggtgacataaaggaggtcaccttttttcctacttttcacgggagctggtaaaatgctaacacagatagaccgtgttttgtgtaataagtagaaaagcgataccaagagataaactaaacagtgcaatacataaatcaaagtggaattgtaaaacaaaaatattcaagaaatatataggaaggtagggataacagaaaaacaaaacagagggaaatagcagaaaatttaaaaaaagatggcaacttcagacctaatgtatcaacaatttcattaaatgtaagtgctctaaataaaccagttaaaaggaagagattggcagagtgaattaaagcatgacccaaatatacactgtttataagaaactcacttcaaatacaatgatacagggagattgaaagtaaaaggatgcttgtgcttgccattggtggacctgtaggcagacctgcccagtccaggcctgcccactgtggcccccattccaccccctagggctgagcagggagctcagaccactgtgcaatccagaatcaccccattgcctgaggcaacggtaagcttcggccactaaagaaggatcaagtatagacccagccacgttggctgctgctggctcttacctataagtgccatctactggattgtaggtcgaactgcacagcccaatataaaagctgaaagaagtgcacagggctatagaaataaagccaaaagaccctacccagcattctctacagttgcacccctagggagggggtaaagggaaaaggaaagaaaactaataatactactatagtaaaagaaagaaaaagataagaatcctggatgaaaatattcacaaaaattagaagtgtcaacatctccagatgagaaggaaccagcacaagaattatgacaccatgaaaaatttgaatatagtgattccaccaaagaattgaactagctttccagcaatgatctataaccaaaatggaaactcaaaaatgacacataaagaattcaaagcatggattgcaaggaagctgaatgaaatctaagacaaggttgaaaatcaacacaaagaaactttcaaagcaatccacgaaatgaagaaagagacaaacatcttccaaagggggaaatcaattagaccttctggaattgaaaactcacttaagaaattttaaaaatacaattgaaagttttatcaatagactggaccaagcagaagaaagaattgcagagcttgaagaccagtcttttgaactaacccagtcatacgaaaataaagaaaagagaatttttaaagatgaacaacatcttcaagaactaagagattatgcaaatagaccaaacttataaactattggcattcctgagagaggataaaaagtaaataatctggaaaacatatttgagggaatcattcaagaaaatttccgtattcttgctggagaagtagacatgcagatacaagaaatccagagaacacctgtgagagactatacaaaacaaatatcaccaaggcatagagagtcatgagactgtccaaggtcaactctaaagaaaaaatcttaaagatagctacagaaaaaagtcaaatcacatacaatgggaacactatcaagctaacagtggacttttcggcagaaacctcacaagccaggagagattgggggcctattttcaggattcttaaagaaaagaaagtccaaccaagaatttcatatcccaccaaactcagctaaaagaaataaaatattttcccaaccagcaagtgctaagagaattcattaccgctaaaccagacttacaagagatccttaaaggaggtctaaacatggaagcaatagaatgatactggctaccacaaaagcacactgaagtacacagcctacagatcctacagagcacccacacaatagaaactacaaagcaaccagctaagaacttcacaacatgattaaaacctcatatattaatattcgtgttgaatgtaaatggtctaaacacccactcaaaagacacagagtggaaagttggattaaaaaacaagacccatctatctgctatcttcaagagacccatctcacatgtaacaacacccataggatcaaagtacagggttagagaaaaacctaccatgcaaatggaaaacaaaaaagattagggatcactattcttatatcagataaagtagaccttaagccaaacagtaaaaaagaacaaagaagggccattacataatgataaagagttcaattcaacaggattcataaaacaagtacttctagacagccacacaataatagtgggggacttcaacaccccactatcagcattagacagatcatagaggcagaaaactaaccaagaaattctggacttaaatacaacacctgaccaattggacctaatagacatctacagaatacacctatcaacccacaatatacattcttttcatcttgcacaccaaacatactgcaagatcaactatattcttggccataaagcaagtctcaataaattcaaaaaaatcaaaattataccaaccatacacacagaccacagtagaataaaaatagaagtcaatactaagaagacctctcaaagccacacaattgcatagaaatcaaacaactctatcctgaatgactcttgggtaaacaatgaaattaaggcaaacaccagaaaagtctttgaaataaataaaagcagagacacaacatactaaaatctctgggatgtagcaaaagcagtgttaagacgaatatttgcagtgctaaacgtctacctcaaaaagttagaaagatctcaaattaacaatttaacatgacacctagaggaactataaaaacaagaacaaactaaccccaatgctagaagaagaaaagaaataactagaatcagagaagaacaggatgaaattgagaccgaaatatccatacaaagagtcaactaaaccaaaagtttgttgtttgaaaggataaacaagactgatagaccactagctaggttaacaaagaaaaaaggagagaagatccaaataggcacaatcagaaatgacaaaggtgacgttacacaaccaatcccacagaaatacaaaagatcctcagagactattatgaatacctctatgcacacaagctagaaaatctagaaaaaaaaatagataaattcctggaaacacaaaatctcttaagatcgaatcagggagaaattgaaaccctgaacagaccaatattaagttccaaaattgaatccataattttaaaacctatcaaacaaaaaagccccagaccagatggattcacagctgaattctaccagatgtgcaaaggagagctagtaccaattctactgaaagtgttcccaaaaatctaggaggagggacttctccctaactcattctacaaagttagtatcactctgataccaaaacctaataaagacacatcaacaacaaaaaaaataaaactgcaggccaatatccccgatgaacatacgtgcaaaaattctcaacaaaatactagcaaactgaatccaacagcacatcgaaaagttaactcatcatgattaattaggctttattcctgggaggcaagattggttcaacacacacaaatcaataaatctgattcaccacataaacagaattagaaacaaaaaccatatgatcatctccacagacacagaaaaagctttcaataaaatccaacatcccttcatgataaaaacccgcaagaaactaggtatcaaaggaacacccttcaaaataacaagagctgtctatgataaacccacagctaacaacacactgaatagccaaaaaactagaaccattccccttgagaactggaacaagataaggatgctcactctcaccactcctattcagcatagtactggaagtggtagccaaagctgtcaggcaagagaaaaaaataaaagacatacaaataggaaaaaaagaagtcaaattatctctcttagcagatgatatgtttctatacctagaaaaccctaaatactccaccaaaaggctcctagaattgataaacaatttcagtaaggttgtagaatacaaagtcaatgtataaaaatcagtagcatttttatacaccaataacattcaagctgagaaccaaatcaagaacatgatctcatttacaacagccacaaagaaaataaaatacctaggaatacatctaactaggaggtgaaagatctctacaagaagaactacaaaacactgctgaaaggaatcatagatgatacaaacaaatggaaaaacattccctacccatggactggaagaatcagtatcattaatctggccatactgcccaaagtaatctacagattcaatgctattcctatcaaactaccaatgtcatttttcaaataactagaaaaaactactgtaagattcatatggaacaaaaaaaaatccaaatagccaaagcaatattaagcaagaagaacacagccagaggcatcacattatccgacttcaaactatactataatactacagtagccaaaataacttggcactggtacaaaaacagacacatagactaatggaacagaatacagaacccagaaataaagccacacacctacagccatctgatcttcaacaaagtcaacaaaaataagcaatggggaaagggctctctaaacaataaatggtgctgggttcgctgtctagtcatacacagaagaatgaaactggattcctacctttcaccgtatacaaaaattagttcatgtggattaaagatttaaatgtaagacctcaaactgttaagaatcctagaagaaaacctaggaaaaaccattctagacattagccttaggaaagaacttgtaattcagtcctcaaaagcaatttcaacaaaaacaaaaattgacaagtgggacataattaaagggcttctgcacagcaaaagaaactatcaacagagtaaacagacaacctacggaatgggagaaaatattcaaaaaacacacatctgacaaaggtctaatatccagaacctacaaggaacttaaacaaatgaacaagcaaaaaacaaccccattaaaaaatgggcaaaagacatgaaaagacgctcctcaaaagaagacagacatgcagccaacaaacgcaaaaaaatgctccatatcactaatcatcagagaaatgcaaatcaaaaccacaatgagataccatctcacaccagtcaaaatggctattactaaacagtcaaaaaacaacagatgctgtgatgctgtggagaaaaaggaataattatacactgttggtgggaaggttaattagttcagccactatagaaagcagtttgaagagttcttgaaaaagttaaaacagcactacaatttggcccagcaatcccactactgggtatatatccaaatgaaaacaattcattctaccaaaaagacacatgcactgggcacagtggcccacgcctgtaatcccagcacgttgggaggccgaagttggaggatgacctgaggttgggagtttgagaccagcctgaccaacatggagaaaccttgtctctactaaaaatacaaaattagccaggtgtggtagcgcatgcttgtaatcccagctactcaggaggctgaggcagaagaattgcttgaacccaggaggcagagtttgcacatcattgcactccagcctgggcaacaagagcgaaactctgtctcaaaaagaaaaaaagacatgcacacacacattcatcacagcactactgacaatagcaaagacatggaatcaacctaggtgcctatcaacagtggattagataaagaaaatgtggtacatatacactatggaatactatgcagtcataagaaatggaaatggacagagaaaaagaaggcgggggacgggatcagaggcagcttcacagagaggcacacttgagtcaaaacttgactcacgtttgaaagatgaatgtgagtttccaggcatatgggagctaggggtgcatggaggggttgtgggtccccgctgggaaaatagcctgtaaggcataacaggaataactgtgattcactgaggacgtactgtgttaggcactggaacaagagctttacaaacattatctcatgtactcttcactgggtgcctatgaggaaggtactatcatccacatttcataagtgagggagcaaggcctacggacttccactaactgcctgaggccacacagacaggaagagatggggtaggcctgattctctgtcttttggattccagagcctacaaccacttcagtatctttgggcaacgataagcaacttgctgttgccagaaaagtgagggtcagagacccttaaaagtgaggggaggtgaccagcctctgacagtacacgtagcagaggagcttggctgcctcccgtaggctgtggtggagcacagcggcctgagtagcatggggagaagcctaacctgcctttccattgctcactctggcagcctgtgagtgcgcagccccggacaggagcccatcccagggactggctgcacagctgttctgcaaaagtaaagaaaccacgtctcctcagtccttacacctgacttcttgtaaatgtccagttcttgttaggttttctaacatatcgcccctggactcctgttctaacctgatgtcttataaacattcagggctccttggaaaacccagggtttctctgaggccccaagtcatccacctgctgagtgagccctgctcagatgcattctggagggaaaaatcacataaattcccttccaatctataactcttcttaaagtcttccttaatgcaatcctcggggacacacacttgacacggctgtacttctctaaaggaagggagaatcgctgtggcctagcccaggccatctgccacacttgcatagaatgtttttcctatggaagcttattttggaatataatcacagaggaaattgagataaacaggcttttccttttctggacaattcttagagataaaatctactgcagaaggcaagacacttaacttctgcccagaaactgatgtcacgtggttaacgtgtggtggccacatcaactgaagccgacagtgacaccgagtcagcatcctgggtgcagctgccaccctgtcactctcatcacattccaccattcccaggccacagaggcaagaggatactctcaaaacttagagatagctttagttttaggaaaataggacggaaaaatatcttatgcctcagaataataggtggaattcaattgctcttcaaggcagcacaagcataatgtccaaataggcttacaaaggctttccctagattgtgggtgattgatctgtggcaggctattaagggaagttcaggatggccaggctattttgaggctgatatcttggagaaccctctctctctcctgcaaaccactcccttggcatcactctcagagacaagctgctggcctgtgcagcccacaccctgactcagggtggcatttttctcaagccctctccttttaaggccatcagggatctgagcccccatgggtagggaacaggccaggcagctggagcgtacaagagtcaccactacgaatagcttgactctgaagtttctaaaagggaacctggaccacctgagcctccccagaagacgcctcagtcacatttaccctgctgctgccattagtatcaggcagagccatctgtacacgcgggaacatgaagggcactttgcaagacttcagctggtgggttaaatgtggctcacagctgtcgctgaggcacactccccaaaatagtctcaacacagcagtaggaaagatgacacagaggtgactgagactaatagcaatacagtattactattatcccttgaataaagtatgtaaatcaaggtgttaaccatcaggagcagagaaaagagagtgttaagtataggggcttagctgtaaaaagaatcagaagaaaaagaaaaaaaaaccctcagttaaagggctagatagtctagaaaatttgttaggtatttatattattaacacagagcagggtaacacgatagaatagaaacctgttacaaacaggcaacaacaacaacaaaatagacaacaaccctagaagaaaaatgccttgaaggaaaagctggaatactgtgagagacttaccagtggcctgtctgcgtgtaactaactcctcatcccgacttggtcacgcaaaggacaggtgaccatacctccaggaaggtggaaaggggccctacatgagtgagaggctcaagtcctgcccaagtggaatctgtgattctgtgatctaaagaaagtttgtggctatttttagaaactaaagtttatctcatattgacacaaactcaaaaatcaatgatactttgagatatgtcatatcacaaaaaagatttctcctctagtacattatcatttaaccaatacaaacaggtctgggccaggtgctgtggttcatgcctataaacccagcactttgagaggctgaggggggtggatccctagagcccaggagtttcaggccagcctgggcaacatggtgaaactctgtctctaccaaaagtacaaaaattagccaggtatagtggcacacacctgtagttccagctactaaggaggctaaggtgagaggaccactgagcccagggacgtagagactacggtgagacatgattataccactgcactccagcctgggcaacagagggagaccttctctcaaaaagaaaagaaaagaaaaagaaacaggtctaatttgttcatctaagcaatgataagatttatatgaacataagttgctttattgatgaaaaattgaacataatctaatcaagcctctaaatttaactgccaatttataggaaaagacaggacagaacctacaggaatgcaatcatttatatctagaatgtggaagattctgcatgacaaacgacttggattcttcaacatgtaaatttcaaggaaagagagagagagagagataaaaaggcttgtttccagatttgaatgacatgttaatagacatttatgagacaatcaaggaaatttgaacatggactgcatattgaatgttgagggattatagttaatttttaaaggtacaattgtgatactgtgattatatttttaaatgcgatcattatcttttaggagcactaaaatatttactaataaaattataggatttacttcaaaataaacaacgataataagattaccatgaatagtggtgggtgaaatatacaaggggcttatttgacatttccataataaaaaacacgaatgaataacaaagcattatagaaattcaagtaaaaaatagctcgtgcttagtaataaatcaaagcgtgctggacactttaaataataaacaaagataagatcttgccctctagaaaacagctctaattcaggacagacttgctcacatcagatggaagagtcagaatgagatgtgctgagtagaaggtagaacggtcgctagcagagggtgggaaggtggtatgtgtgggggagaggagaaagagaggttgattaatgggtacaaacagacagttagatggaaggagtgagatctgttgttcgacagtagagtagggtgactacagttaacaacaatatttgcatatttcaaaatagctagaagacaggacttggaatgttcccaacacatagaaaggtgatgaactcaaggtgctgaacaccccaaataccctgacttgatcattatgcaataacaaaatatcacatgtaccctgtaaatatgtacaaatactacatatcaatttaaaaattttcacacaagaatgagatgtgctgatgcatgtggaggccctagctccagactgggtgtaaacttcaagccactgaagatcttatttccaaggtttttctactttgaaattccaaacttatttttctagcagatttataagggacacgggacaacataaacttgttaaagtgacaagagaaagtaaatatgcccttaaatttataccaaatcttctgacaagtcttgactgataattgtttccttcaaatttgtgaaaaacatgagagaaaacgtgtttgtatctcatttttaagtgtggacacttggcattgctcacggcttccaacggaataaaatagggcttagttgttttccattagctttttcctttgtgtgtgtgtgtgtgtgtgtgtgtgtgtgtgtgtgttgtgtgtacatattggctctaagcatttattagcccaataatttttagtgaaactctccacttctcaatatcttttgccgtattagatttttgtaacatgtgctaaaggttaaaacaccttttccccttcatgaagcctgagagaagtcggttttctgggttttctcaagacaacccagaggttttgtatacgtctgtctaaaaagtctcagatttttcttgctaattgtgcaccttcataatcaagcagacaaatcagaatattattttggtgaggccatcatctaaactaacagtctttatgtacagaagcagcactgaccgggttcatactcctcagttagcaagtcaacatcttcctcctgccagcaacccatcccagaatatctgtggcttattaatacttatgaaaacaacagtcttcattatttactaattaggagatgatcagatgtatctattgatagcaacaggctatttaaaagtgaaataatctatcaaacagattttttatcaactcaaagtttccagttagatatttttcattaaattgattgctagattgcagccacaatcaaacttaagtattataagaagtttggttggtcttttaaaatcatgcaaaaattcaaggggtgctattaaatatagaattccaaatgtataaagtcttgtcctaaaatggtcaataaaatgaaccagtccactggttcatttatagggggccagtccactacattaatttggatgttcttcgtctgcattttcatgttttcacacacctgcagtcattgtgtacaattctggactcttgattttcatttagcattctgcgttaatattctgacatgttgctgccaggtcttcatggccaccacttttaatggccagaaaatatttcatgtagtgaacatttcataaattacttaaccatgtcccaattattggttatttaaggaatttaaaactaaaacaccactcttgtgacaaagttctgatgtatccagatgtactcatgccaagtcgtccatcaatagttctgctaaaccctgtcagagcccttttctgaagggaaccaggaaacatctcacaacaagaagcttaaggcctctacaaaatgacttcagggttaggatttcaatttcactctgaggcacatacaggaaccactaggttatttggcttagaatggagggaagtgtcattttgtttctgttcggcctgcaggaagctccttcccaggccctgcattgccaattgaacaattgaacaattctcattgttcaattcccacctatgagtgagaacatgcattgtttggtttcctgtccttgcgatagtttactgagaatgatggtttccagcttcatccatgtccctacgaaggacatgaactcatcattttttatggctgcatagtattccatggtgtatatgtgccacattttcttaatccagtctatcactgatggacatttgggttggttccaagtctttgctattgtgaatagtaccgcaataaacatacgtgtgcatgtgtctttatagtgcctagaacataataggagctccagaaatactgttgaaaaaatgaataaattgagcacactaagtgtctgaataaaataccctgaccatacccctaaataaacaacataaataagcaaatttcaatttctcggaaaagttatattttagtgtccaatgctcttgttatgcagtaatggcatctttgattattcatattcgttagagcttccagaaaggagtattgcaaatcacacgggcctctgactctcatgaccaaatccccctgtcactgtccttgttctctgatccttcctctgggccctcggaaatgctggtctccatcaaattgctgtaaacagttttcagaaaaagttctctttgggaagtttcaagagaaaaccacaaatttcctggaaatgcttcatgcttcatgacatttaaggctttcagagccttgaacttcaggagcaagatagctggtaggtcttctggaggtcttgcctaacctgagaaggtcccagagaatttgtgcatagaacctcccaggaagcagtaagacaggctggtgcagtcccacaggatgagaaaggtaagagcttaccaatgtctccagttttgtaaatgaatgttcttagcatttttggtgaggagaaaaaaatatcaaacccatcacagacagatcagcagtctcttgacctaggtcactcaaggggttctcaacaatcaattctaaaatgcaagtgaaaaatgtcaatataaggctagacacaggggctcatgcctgtaattccaacactttggaaggccaaggcagacctagaactttgtaaatctgagattttgctccatgactttgtggatactttctactaataccacctacacaaaatcttcaaccaagaatcttaattgcatttatcaacttgtgtccttagatcataacatttagattcatttgaaagaaatttattgaagtaaaagaaataagaagaacttgatagcacaaaacaaagaaaacccagaaagagagagagagagagaagcagaaaaactaaacactgaaacccagagagagagagagaagtagaaaaactaaacactgagtcttaatctgttctgccactagtcagcagcctgcacagagcactttaatgtattctctgtccattagtttccttgtttatgaaagtatatagctccaaaaaaattctgtgttctgatttttgtctctccaaaccacaaccagtcccctgctcccttctctcctcctcctcctccttcttcttctttctctctctctccctgtctctctctctctctctctctctccccctttccctctcccccacccacccacctcccaacccctgcatacacctaggacacctccagcataggttactaccaattttgcacacctccagcataggttactaccaattttgctgggtttatctccttctgtcctttccgctttgatctgaggaatagctgagatttaggacagcaacaaggtgtacctccttccaggttataaaacaggattaatgattaggctcaaggccccttcctagtcactcagtaaagtctgtgcactggaaaactgtggtagcagttttctgagcattagaaaactgtggttctcacagaggctggatgagtcaacactgccatctggcggcctcttggagggtgatgtggagcctggctttcattgaagaatgaaggtcccttgatttcctgaccctcagccaactctccagcagcttctcactgcagaagaggtcaggccattggtcagcttgaggacaaagtgggaggatcacactttcgatcacctatactttctaacaatcagccctgtggacatctgctcacgccccatgctgtttttaaaatattttcccattatagaaatatttttcaaagatgattcacaagctccaggagccattcagacaagggagagcaaattggcagctaaactcattcaagagtggagcagatgcacatgaagctctgtctggcggaggaggcacaagacaccgagcctggctgggagggtgctcatgacaagagtggggccacaggcctctcctttcattggacatagtggccatacaaagtggctgccttgaaatgcacccacatacactatcggtcctcccggtctagggagaaaactagcacagtatgtcaacagataaatcagcgcaatcctgtgggtgaagcagtgcacccatactcttcattctgctgagcggaactcaagggtgagacacttgtattcctaactccacttgccttcaggctcctccaacattccaaattgcccatggacagagctactacccctccatagaagtgacaacttgaaataaaagatttgaagctccttcccacgtttagacccaggcctgctgctaggaactccagaggagggatggaaagaagtttgcactgctcacagatttaatgtttctctcacaaccagaagtaggcagcaggatggattttcaatcaacactaacaaacggatcactcctgggtcctttaaacaagttccatgtctctttataggttttaggtgcctcctatgtgttcagacttcgtataatggatatataagaaaagtaaatgggaggggcaatatttaagaaataacagcaaacaattgcattcatatttaatataaactacaagtatcaagttaatagacgctcagaagaaattcataaaatctagaaaagttgggaaaatctcaatagagaaaataaaacttgatctggactttaagagtatgatttataaagttcaaggggacagtacacaaagtcagacaatgttagctgaatcactgaagaatgagaatatcacacccacttaacaaagcagcccagctagttaaagaagtatgttgaagaggtagggagttgggtgggggaggcgaggatggcgtggagggatctgaaaactatcaaccttaaataatgagatttagaaaatatgattaagtagagggttaattcgagtgcagagcttgagaatggccacctggaaacactgactctaaaccagtaaggttaatgtttcaaagtggagaagttaaggtttcacttagaaattttagcaggatcacattttccatacaagaccagtgcattcgccacagcaatttgattggttatagattgctgctcattccaagattactttattactctgtgcggaggagtagtgatttgaggggtcttatgtctggtgcctttttgtcttgtttacaggggaaaaggcagaagttgcgcctgcatgccgcataactcaggctctgcatagccacatgtctttcaaggctcagaataatttgaagttccaacagctttaagtttgaattaatttcacaaagcggagaaagacttggacttcgtgcagtaatgaagaccaccgatgggtactgaacagctctggtgggtttgcactcagagaaaggagcctaagatgcagaaggtgcagtgaggcagcagccatctgctcttgtgctgctgagcagagcatgatgggctgtcaccgctcacgcgtgttctttacctgctgactcacctggcggcatgggctgcatatggggtcccagctccttaagctcctgtcaggcccttctgcaacttctcccaagctcttgggccaggtgcatgtctagccatgaaaaaggaggccagtacctgatcactaagtgaaagttctaaggtagtgggactgccacaggtgtcccccatggtcccaggtcacaatccagtctgttgaccctcctccttttgcaccatcgcccctttgacagcctgtgctatgggttttaggctcctagcaccaaacagaaacaggcttatatagatcatctaatcagctcttcttatgtgaggccgaactctgtaataaatctttttatgtctcctagggcttctctgattgaacctgtctgatgaggagttaaagaagttctcaaattgtgtatgcataagaatcacctgggatttctagctcagagactgggacaataggtctattgaacctaggagttcattttgaacaagtgctctacgtaattctgatacagggaatcttccagttacagtttgaaattcacaaatacaaggaatgagagacctagaatcagaaagcatgttaatacacttttgggccattaagtgctcacccaggtaacaggtacagaaaggcagaaaaaggaaacctatcagggtaataattatgcctttttttttttttttttttgagacagggtcttgctctatcacccaggctggagtgcagtggcacaaccacagctcactgcagccttgacctcctgggctcaagtgattcttccagttcagcctcttgagtaactacgactacaggcatgtgccaccatccctggctcattttttgtagagagggggtttggccatgctgcacaggctggtctcaaattcctgggctcatgtgatttccccacctcagcctcctaaagtattaggattacaggcgtaagccactgtgcttggccaagacattttggtaagaaatattattttcctactaaattgtctacattccccttgggtaggcttgcaaagtcactgtgactacagcaggagctattgctgcatgggaaatatggagacacgagtggtacctggcagtcacgggctcagtttgtttctaacctcccaagtcagcacagccccactgagcagactgccggaaagtatttatgccatctgtcggataattaagacaaatccaaacatctacgtgcattctgtgtgtataaatggagtcatggccaacctctcaagcagttttccatcaatcacttgtaatattaccagatacttccaatccccttgcaggcagtaatgaagagaaagtctctacatcagcagcttctcactggaatcttcaagcctaactcttaagaatgaatcatacttctaatgtttatcaaaggttttcttttcacacaaggaatgtgcctgaatgatctataaaactacccaaataactagtagccaggttagctctaggagccatatgccaaacacattctggactaagtcgtgttcactccaaaactaagaccatgttcaaagtctacagcaatactggattaaaacaatgttagctgaaggttgtaaaaaaacatcatggaacactaattatgtgccatcaatcattactcaatttgtagaacttccctatacaccttgggaggtgagaaccttatagaaaatcctagatacacaactttatataaacagaaaattccaaaatgggaaatcctttagaataagaatatacctagtgtatataaagaagaaaaaatgtagatttgaaattgggatactctacagtttttagttgggacattgggatagttaattttaggtgtcaacttgactggattaaaggatatcaagacagcaggtaaagcattacttctgggtttgtctgtgaggatgtttccggagactggcctaggagtttgtggactgagtgcagatcagcctgtgtgagcaggcaccatccaactgaatggagcccagatagaaccaaaaggcaaaggcaaataattcactgtctttctcctcgagccagggacttgattagcaacccctcacacccaactccttattttcaggacttcaagggttataccatcagcttccctggttgtgaggccttcagacttggactgagccatgctgccagtttctctggctccccagcttgcagacagccaggcatgggaattctcagtctcaataactgagtgagccaatttctttaataaaccctttctcatctctctctatatacaaacatatcctattggttctgagtctttggagaatcctcatacagacactgttaagagatgaaccaggtgttaccactgtgtccccaatgcctgggatagtgagtgacagtattgatgtttgtgcaataaatgtttacaatgtgtatctactagcagctttcgataatttgaattatttataaaaggcaaaataaacaaaagtggtatctaagattaaccactaacttagtaaaattccatttataccacaggttgttctggtacaaagcatacaataactcccatgttacatataatttgacttgttcaataacaagaaaattactcaaatattataatggagttaaaatgtatttaatagatctaaaaaattttggctctatcaaaacttaggtctcaattataacattactaaagtgcttgtaaaaattatcccagatttctggctacagcttgtataaaggcctatttttttttttttacagttttattttggttgaagatttttctccaaaatagctattccagatggcttaacagtcccagaagtgaaaaatcttaagatatttcatttataaccattagagtcttaataaaaccctagtaaatactctcccttctggatggtttaaaggtcccttcaggcaagctggctgcgtaaacaccagagccctcttcataagataagtttgctcaaaaggtcaacttttacagagaaattcctacctcattagtgtaagggaaaattaacatgacctgttttcattacttaaaatgcaaaaaaaaaaaaaaaaaaaaaaaaaaaatctcagaaaaatagaaaagggtgggaaaaatgaagaaaattaaaagaaattctacttcctatatctgtcctgcttagagaagacaagttatagcaaaatgagtacttcaggtttctcttttaataaacaaaaccatccaaggtacagttccaaagtacaaaatcaaccaggtctgaactgattggtgataagagcacacagatcagtccttccttaaggaaacagtttcctccctgatgccctctttggtcactatgcagatccggagtgcgtccccagtgtacacatctctctcagccgcagaaatgaagacatctttcaccagccgcatggctctgtccaaggacagcggaacatgctccacattctgcatgttcttaaaaccaacctggtgggacatgaaacttgggtgagatgtcatgtgacagtgagcacaaaggaaaggttcaagtttcttccaataccctcatgtgtacgaggatttgtgatgaaaatactacacaaaattaaaatgtccttcagactgaataaagacccttccagacctggatgaattacacacatcagaaatctgacaacgattccctggcaaagctcccactcttgagaagcacatgacccggagaggtggacgtatgcaagcaaagtgatcagagaattgctataactaagaagaaaataagagccaggagagccccaacagatgtccactaagtctcctagaagaagacaggcttcagcagaaaggacttttaagtaggtgagcgctgaaggctacactgaagagcacagaacattccagactgaagatgtgggacggagttaggaaaagcacatcttttctgagaaaagcagagttagggtctgggtgtagtggggtgacaggagatgaggtcaataagcaataagcagaggagtagctatatatgacatccttcagaaaactgagcaggaggaattagggaagtaaacttgtaggcagaaaggatgttaggaaataaatccaataatctaataatgtaggtctgaatttagccagcagtaatcacaaagagggacgaattagaaatacaggcggcctttgaataacaccgttttcaaccactcaggcccactgacacataaattttcagtaaacacactgagaagtttttggagactcgcaacactttgaaaaactcagatgagccaagtagcctaaaaataccttaaaaattaagagaaaggtatgccacaaatgtataaactatatgtagatactagctattttatcatttactaccataaaatacacataaactgattataaaaagttaaagtgatctctcaatgttctcctttgtttttcattgtgtttagtgcgattattataaaccttaaataacaagtggcccaaacaaagcactattagtgatgctggaactgctccccaagaagcagggaaagttatgacatcacaagaaaaagctgaattgcttgatatgtactgtagattgaggtctgcagctgtggttgtccaccactccagacagatgattctccttgtaaacagatgatgtaaacttacagtatcaacaaatacagtattgtaaatgtattttctcttcctataattttcttaataacattctctttcctgtagtttatttatcataagaatacagcacataatacatatgtaaaatacgtgataatccacagtttacattattggcaaggcttccagtcaacagtaggcttatttgtaagttttcttggagtcgaaagttatatgtggattttccagtgctcggggaactggcgccccaatccccgtgttgttcaaggctcaactgtatgcttgggagttcaagtacagtattgggtaacacagaaagggggggtaagagggaaaaaggcatttttatgatcttcaggtaaagacagcaagagaattagccactacagacataaaagagttggaagccatgagaatacaggaaaacaatcaaaaccatgggagtaggtaaggacccacaagagagtaggcagaacacagagagagaccatgaggtttctgtaggacacgtctgccaaactcaaacagtaatttataagaaagtctttatatcttggctctcctaagctaatgaagaggagaacttggaggaaggcacttcaactgaacaccatgacaagttggacatagtatcattacctggacacagtatcattacctggttgtcaagcaggggctgtagcatggcacttgctgagcctccagccttgaaggagtctctctggtaagaccctactggatcaaagctgtatacagccccctttccttaaagaagaaaacagtattcataaggatggtatccaatcacaatcccaaatcatcgcaaaaataaatcaggtcaaaacgtgacacaaaacggactatcaccttggctaaaacttcagggaacagttggaacacagccactgttgcactggtgacagctgcagcacacacactgttgcacatgtgacagccagaacccagtcaccattgcacaggtgccacccagcagacagccccaatccccgtgttggtgtgttgttcaagggtaaactgtaggcttgggagttaaaatacaatattgagtaacacagaaagggtgggtaagagggagaaaggcatttttatgatcttcaggtaaagatgacaagagaattaaccactgcagatgtaaaacagttggaagccatgagaatacacaaaaataatccaagccatggtagtaggtaaggacccgtaagagagtagggagaacacagagagagatggtgaggtttctgtaggacacatcagccaaactcaaacagtcatttgtaagaaagtctttatttcttggctctcctaagctaacgaagaggagaacttgaaggaaagcacgacttatgtatatagacaggtccaagggacacatccgcaagacacagtaaaacgaagagaattctgtaacctgtaaaatacgatactgcttttgtttaaaagaataagaaaactatttgtacaagcacaaaaaagtctggaaagataagtaactgtggctggtcatctttgagctctgaattagaggcaagaaaagaagggaattaattcatgtgcttctatcttatttgagtttgttacaaagaacacaggtgattctacaatcgttaaaaaggcctgttaaaaacaaccgtgttctgggtatgagaaatcacgagtcatttacaaggtatgattttttaaaaacataactgatttagaaaacacattatataccagaactcagtaccctgggagatgtgatatagggacaatctccttactaaccatgtacaactgccactgttagctttgtatgttttctactatagaactgcgtaaacttggccaggcgcggtggctcacgcctgtaatcccagcactctgggaggctgaggtgggccgatcacgaggtcaggagttcgagatcagcctggccaacacagtgaaaccccatctctactaaaaatacaaaaattagctgagcatggtggcacgtgcctctattcccaactacttgggaggctgaggcaggagaatcgcttgaacccaggaggcggaggttgtggtgagccgagatcatgccactgcactccagcctgggcaacagagcgagacttggtctcaaaaaaagaaaaaggattgtgtaaactgaattctctggtggagaaggcaccatctgaggtcacctaagaaactgggaagtatttttgctggaagcaagcttgggacaagacatgagatcacagcaggcaatccactaacctcaatatacaaaaaaagaaagagatgtaaggtgtaaaggcagaaaaatgattgtatctctcatgaggatgacaggccacaagtaaactgaggcccaaaagctttacccaaggatggaaccaatctcagaaaaccacacacaacaaatttaaaaaaataaaccaaagaaagggtgggctatgtccaagaacacagctttaaagaccccctagaagaagcaagagagacactagtaaaatcagtataaaacagcaaaaatcaataaataaaaacaaaaataaatgtagaatggcatgaatcttgattacaaagtgcttttcctcatcaaagtaaaatccaaaaagcacaatcatttcaatgtaaaaaataaaatcagacaagtcttaaaagaaatacagctaagctttggatgggagaagtttttctaacaaggcaagaaactgaatgtcataaagaaatgattgacagattagactgtatgaaacacagcaatttctgtgtagcaaaaggcaccacccaaaagagacaaataacactcttgggagtatctataatatcacagacatttgacacagtcgaatgtagttcttgaaaatcagtaagaagaaaactaacctgcaaataaggaaatgggcaacagttaatatatgaatcagtctccaaagaggaaatttataaagtcaataaacatatgaaaacatgcccaagaatatatataaatgaaaataataaactgttcaataggcaaaaagatgtttcaaaatgtgttaattctaatactgggaaggttatataaaatcgggtactcagggtactggcgtatccttcagaaagagtatactcaacaaaatacaaaaaaaaatttatctgacccaatacttcaactactcgaagtttattctagcaagacaagcataattggggaagtacacaaaaatgtatgtacaaggatgttcatcatagtgtttatattaagaaaacaggaagccaaaatgccctttagaggactggttaggtaaatgatgctatgtattacagcagcaaaaacagaagacaaaaaaattttttgttaattaaatacaaaaatcattatgcatatagcttagatctccttgataatacataatgtatagttacagaaaaacagataccaaagtcctacttacataaaactgcatgagtgtatgtataaacatgtactgattgttttcactacagaaaaactaaagccacttttaatttgggagaaaaatttttaaaaggcatgagagcagctaagagattaaagacagagaggttagtgcagacagcggttgacaccaagggaaagagctgtggaccttgctgtcctgaaggtttcaatatggagcactgctctccaggtccctgcatccaccaacacagaagacagtaaaggaagtctcctgagacattagcagaggctctggacttaggggaccaggctctagagtggcaaagggtaggagcaaaacacatgaaatggaaagttgatgtaaacaaaacacagaccttcagcccccttcctcctctgaggcctaaaaagctgccaaccgggcttctcttcctgtagtcccacctcacctcaggaaaaaagattaaagaaattcttcatctgaagaaaatgctgcttacttaagcacccagttaacggctgtcagttgacaagccatgtcaacaaggactttcataatcaaattttggtacaagactcttcaatgtgaatggacagcaaaaaaaaaaaaaaaaaaaaaaaaatcagagatttgaaggaagcctctaacatagaagacagaggccaaaaatgaacacataacatgaaaaaaaaaacattctgatgaaatacagaaaactgcaaagaaagtaaacaggattttttttaaaaagacaaaaaataagtacaagctcttggaaattaatgacaccagaaataaaagcaatcagtaaaggatgaaaagctaaaattaaggaaatcttcataaagtagaacaaaaaagacagacatggataacatggggagtcaaaaataaagtaccgggtcataatccaggtggttgtggagaaggtgcagaggggtaggggaggaggagaggaaagaaggtggagaaagaggataaaacaaataagaaactctaggcaaggaacatcactatacaatttcagaacaccagggtaaagaaaagatcctaaaagcaaagtctcaaaaaggtcccgttttgtttttttcagaaatcttttaggaggtaagcctctaaaataaggaaataaatcaagaaagaggagaacacaggatgtgggggaatctcaggatggcagtggtccatcctggagcaaggggaaaagggatccacctagtatgtgaggtctgacaaccagatgaattgtactcagagaatgtacaaggaactgacaaaaagtttaaagaaatctgagccaattagagatagttaacttaagaaaaaaataaaaacgagttacacaagaaagaaaatattaatgcatgctacttggcgcaacaaagatcaatatctatctggtcataataaaaacattaaaggtctatgttaccaaaagtgtaatgtgttaaaggaggatgctaatgaggaagaggacacaaaagagctaagaaccatcatctaccagaacaaaacaccaaaagatatctcaaaagagtgcagtacaaatacagagttttggaaaatggaggtaagtaccaggaaatacaggtaaaagagctgaaaactgtcttagggcaatggaaaaaaaagatagaggactgctttattattcacacaaattcctctataaaataaaaattagtttaaagaacacttaaaagccaaccagacagacaagcttagaaagacagttctagagacacctgaggttgtcaccaaaactagcaacactgttacatggaaatcaaagaacagggctctgaagtgaaacaaaagccaaacctgaatcttaggtctgctgcttagtaggtatcagctttcccagattagactctctaactctcggaaaaactcaaaggatgctgtctggcctgctgaaattcaatggcagctcagctatttttaatgttgctaaaatctgaatctattaatctgacattaaagccaggcataatgtaagtcaaaaaagacaccagaagcatccagcttgctaagttaggcaaattaatttgtagctagactctaattacccatgttaaaggtaattcatttctatttttactatttctacactttactttttctcttggttttcaagtaaggttgaaagccttaaaaagaaattgtgtcaacctaatttgtctacgcctaaaccatggcaggtaaaatgatcagaatgttccccaaggctgtgtatgggggcggatgttaagagtcagagatagcgcacgcaaagaaaacgctcatggaacagaaagcgataggagtcaacaaccgagaggcagggcgctgaaatgaagcttgaccctttcctcttagaattttccctcacaggatttagggtccccagtccccttgctttctttctgtgtccaactgagatgttctgtgatgtggccagccgcatgtattcccctggaggctctgacccaagccaaggcctgccttgaacattcccaggcgctgacaatgttgtttaggctattgcttgaaacactgagaaattacccctgttgctaaacacacagaaactatccctggccctgaaccaaattccttcaacactcaaatcaactccctcaccttggacacatcttttcctgctgtctgctgagaggactgctgcagcactaaatgcttttgactgattaccctgagatttagtgttctggaaccccaactaggttcggggcagtcccttacaggaattcctctgcccctacttttagggcaacttcagccacaggttcagccagaaggaacacagaagatgggcttactccaatgatatcctcatctagacacttctgtaacttcttatctcaatggactactctaaatgacacagatggactacttatccatctgtgtcaatggactactctaagtgacaaagatctgtcctgggacactgtacttgtatttgatttttagatgcaaccaaaagccaatccaaatgagaacatttggattgcaaatgagaacaaatggattggaacatttggatggaaaacattggtgcccatgtggcgtaatgcagctctggaacaaaaatgggatggaatattaagtaacaagacttaatattctcagggaatcctggtctgactctgacaaaatcagagaggtgtttcaaaaagttctgaaaacactggagtagatgcttattattaattaccccaaatgacttctagaaccgttaaagaacttttttgaagtgtatttgttaataaaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggccattatagactagaacaatcaacagtataaagtgaataaataaatgcataccacagtggaaggggaaagcatgcctatttccttcatgatcaaccaacacagtattactaacataaaattttaagggaaggaatgccaagtttgccctcagctctctggtttagactctattttccataccacccttatctcaggtactgctaatccaagagctaatgtgtatgaaagggcacatgaagtggcctaaggaagatgggtttaaatccatctctctccctcactctgcatatagaccaggggtcaacaaactacccctgtagtttggctcaggggccaaatccagcctactccctattgctatgaatattgtccgtggctgctttttcactacagaagcagatcaaatgaggcccataaagctgtaaatatttactatctggtcctttacagaaaaattacggcaatccctgatcaaacctagatgtaagtccctctctttgtggagcagatctctgtgagaacagaagacacagggcagcacccttactctgcatgattttaatacacagcagtggtcgtgatccttaaaacatctacagtagagaacacaagcatccaaaacagggtcttagcatgacaatacagtgactgcaaatcctagctttactatacctttgcgagccctacattacccactggtagagaaacttcacaaaaattataaacataaaatgaattcaagatcaccaatttttgttaaccacatagcaaacatctctaatgagaaacttaatggccaggcatagtggctcacacctgtaatcccaactgaggcgggagaatgtttgagcccaggagatgaaggctacagtgagctacaatggcgccactgtactccagcctgtgcaacaaagtgagacgctgtctctaaataaatagacagatagatatctaactagcaccgtaaaattaaataatgacagtcaaaacactgaaaaatgattagaaatgaactacaagtaacaggtaagttttttatagaggaatgcctttccaagataaaaactataaaaaattattcataggccgggcacagtggctcactgctggcctgtaatcccagcactttgggaggccgagatgggtggatcacctgaagtcaggggttcgagaccagcctggccaacatggtgaaaccccgtctctactaaaatacaaaaattagacaggggtggtgacaggtgcctgtaatctcagctactcgggaggctgtggcaggataatcacttgaacccaggaggcagaggttgcagtgagccaagatcatgccattgcactccagcctgggcaacaagagtgaaactctgtctcaaaaaaaaaaaaaaaaatttcattccatttcatttcgaaaccaagcaccaacatttatttacttcaccacctaataaagtatgagagaaaaacttcaggaaggggtgtgtattatgtagaattcaccattccttgttttattaacaatatcatgtttacttttgtcttctaactcccatttataaaataagcattaggaattatcatataaatatgccaataaatgtaagtcactatggctttcaatgtaagtttctaaaaaagcattaacaattgataaatactgagtgaaatcctttctacacattcaaaaagcatgtgtcagttaaataaatatactatatactccagtaaccactcataagtgtaaataatctcaagtgttattcatgaataggcaaaacagaatgtgatcacccctgacttctggcagctggctatcaactgaagctggtcaggtgacagacgttaatggtgcatgttgtgcctcccatccaagctcccagcttattcattctttcgtatttctactcatgcatcctgccaactaagagcacagcactgtaaagaggaaaagcttgtcaactgatggtgatgcaaaccaagctcctgtgtcaaatctttcctgggctctctcctgccacagaaattgatttgctttgtttttgagggaagagtatcttcagaagaagaactcctcccaggctccttctaaaagggtagagaacccttcatatgatacaagactttaacaaatggaatgtgctgctgtttcacattatgctactttaatgaccctgcattaatgatatcatttcatttctagcatacatttgtaattcatctactaacctagtgactctctagctatctgaccaacagtcatgctgtaggcttaaaagaatttaatgaattactattaatttaaaatagtgtagaaatgtacaaaagcatctacctttagtcttgcttcaataatctttgtcagcgtaagacagtctccatgaaaaccgctgcatccaatgactgttttgtctgttctgtaaaaagcacatttcagaaaactgagctggttagatagtagagcaaaacatatcttcggcaattttaaatttaaaattctgattcccactattccctaaatggtaatgggacaaacagtcacccttctggggaggaggggtctgtattccatcttaccccttattccagatgaattacaggtggatcaaagactttaaaaatgcgactatgaatggactaaataaatcatgggtgaattttttttactatcttgggctgaggaagatacgtaggtaggttaattgactgatttttgagacggagtttcgctcttgtcacccaggctggaatgcagtggcgcaatcttggctcactgcaacttccgcctcctgggttcaagcaattcccctgcctcagcctcccaagtatctgggattacaggcacccgccaccacacccagctgatttttgtatttttagtacagatggggtttcaccatgttggccaggctggtctcaaactcctgacctcaggtaatccacctgccttggcctccaaagtgctgggattacaggtgtgaaccactgcacccagcctcgtgaaggtagatttaaacaacacaatccaagggccacacagaaaaatttcataaatttgactacataaaattctacagggaaatttaagaatagctttttaaaaccctaagaaaatatattagtagcatctacccccaaagtctaattttaattctataaaaattcttacaaataaggaaagcaataacataaaggaaagatgggtaacttctatgaacagacaagtcacagaaaaaagagacattaagtcaccataaacataagagcctctatgttactcagaaatccaaatctcaaaaagagactatttcaaccaattatactggctaaaaatgcctaactaactaaatgctggtgaggttgtggaaacagtataaactgattaacctgttagatgggcaatttggtggtatttattaaaaatttaaatacacaccactctcaccaattctattgctagaaatccatcttgttaatatacttatccaagtatgcaaagggatgctctagactcaccagtgagtactcatttaaatagcaccccaaaacaaaacaaaacctaaatgtccatctgtatggagaggattaaaatttggtatagacatacaaattcaaccgtgtatttcaaaaattaattcctagatcttgatatgaatctataaagaaacctaaacaatattttgcagaggccacacaattcctcttggaaacttacgaatgactcgcacaaaccatacctgtcctactaggagagcagctgacacctctagggtcatcactaacatcacctgatctatgcctaccatcaacctcactgcactaaggtgaagacgtccaatcccctataaggctttactgcctttactgacaagattggttgacaataccaacagggaaagacagaaatcttagaacttcaagatgcttttcccaaatatccaggtgcatcaaaggaatgggagttttcatgcaaagaatacagtctgaaacaggtttggaagaggcaagcttagttctaggtcagacccacaggacgtgggatgagggatatatacaggcattcgttaatgctgcattgttcttattctctatctctatatctgacgtgtttcacaaaaaaaaaaaaaaaaagtgctcacttcaccagcaaacgtaactaaagcaatatttaaaagatgagtaaaagctagtacaaggatggtatccataaagttgttttaaaatcttatttctaatatttactactttcaagttgtacaagtgtcgtccttgaggagaaaaaaaggtaacacaagagcaccataaacagaaagcagaaagggggtatcaaaagatgcaagtggagagaaacagaactgggaagacgaaaacaaacttcattgctttttaagatgtgggccatccctaggagcaggaaagacaacgtatcttttcttctgtacctacttcctacaatacaaggagggtccatccaaaggacctaaacctcgtaagtcccattcctattacaattcaagtttaattaacccaggaattcatgaccatttataagcatttccaaaactggtaaatacagaccactgccaatctgcagtatgtattcagtatttatgcaggctttttgtttttttaagttttggctttattttcatgttttaggaaaaacatagctagcctattaaaactgagctgtggacataattgcttaggatatttctaaaacgaatgtttcaggtaaaaaaaaaaagtgtggggaggcagatttaaaaaaaatatcatttaatggattaatggtgctgtggtttgaatattcccttcaaaactcatgttgaaatttaattgccattgtgatggtactgggagttgggaccaggtgtttaggtcctagggctcagctttcatgaatggacattatcacagcagtgggttcgcttgctcttctttctttctctggccttccaccatgttaagacacagcaggaaatttttcatggtaaaatgctggggtgaacacatttaggttaccgaaagcacttttggtaccctgaatacagcaaatattattaagactgcacattaaattattaggaaacattaacttagaaaatggttttctaataaaaatgctcccaacagcaacttaaaaactcatgaaacaaatcatttagaagtagaaactctcacaacatcaaatcattacaaaggcattgtgaaatgtctttagaaatatttacttacaatttgtaacatttggggctatcccgcgtatgaattgaaaacccttcactcaatcgagtatcagaagcaacaattgcaaaatcttctccagcaattgccagtatagtactgaggaaaaaagaaaaaaattaattctccagggtggtaatcctatccctacaaatagaagaatgctccatagtacataatgggataaaatactctagatgtcaacaaaaacatgattcaaatgggaagaggaaagatgagcgggaagagaatgaacgcctggctacgagttgtctgggaaaaaaaaattattaataagcctaaatcagggcaaagtctccttggcaggagttaacagaaaagccaatgaattatcatcaccaacacattaaatacttactcgcgcaaggtactactaatacagaacaactaaataccacatctgtgcccttgaggatcaggtatagacagtggtactacaacgcaagctctatgagtttagagaagatgagatttttttttcttgcttcatttctttatatccaagtccttatataacgcctatataatgcttatttctttatacccaatcccttatataatgacaaatagatggacaaacagtaaatttttccctctgtggctgtacaatttgacagcttatcaaagagacttacagtagaattccaaaagcagaccgcctgggttctaattctggctttcccgtttcgcagatatgagactgtgggtaagttacttctcaaagcgtcaatttcatcatatatacaacagagatcactgcagttgctacctcattagggtgttcaaaggatcaaatatgtaagcccttatagcagtccctgacatgtaactggtcctctagtaagtgttagctataagtgctatggcactggagtatgactaagcacctgggctctggaattacatgagacagagacccactcttgctacttactaggtatgtgatcttggacaaatcctccaaatgcaagttgatgataacagtacctgtgtcacaaggtgtgtatatatatttgggtgtgtatattttaatgtacaaggcttgactgataactataaccactgcttcaatgcaatagtggaaattaaaggcatggtgcctcacagacgtaagcactcaggaaacttaagccactatttttactgaggagggatttgtgctaaagctctcaagaagaaaaggatggcattccaggtaatataaacagcaagcaatggcaaacaggtaattattcaaatagtacatacattcaagcaactcattcaggcagccctttttgcataagcacatgtagtgacgttaaggtttatgtgatggacagggttcctactgtagaaaatcccaaatgccaagctaaagattttggaattttagcaagaaatcatgaaggtattctgagcaagaatgatctgtagttgtaactactcaagaggctgaggtgggaggactgcttgagcccaggtgttcaaggctgcagtgagctatgatcgtgcctgggcattagagtgagacctggtctttaaaaaaggaatgcaagagagagaaaagttccatttacaaagtggggttttaggaagactgctctgacaataacatagtatgtgaaatgggacagaaacactgttctaatactactaatgcaatagtaaggtagcagggtgaacagtaaatccaaaatcatcacaaacacacaaaatagacaaatttttatatctacgcaaatgttttaggaactgggaaaaccaattatgacatccaagatttagaacttagatgaacagaatgatggcataattataagtattttaaaggagaggaggccgggcacggtggctcacacctgtaatcccaacactttgggaggctgagggggggggggggggtcaattgcctgagatcaggagttcgagaccagcctggccaacatggtgaaacccatctctactaaaaatacaaaaattagccaggcgtggtggcaggcacctgtaatcccagctactcgggaggctgaggcagaaatgcgtgaacccaggagttggaggttgcagtgagctgagatcgcaccgctgcactccggcctgggtgacagagtgagactctgtctcaaaaaataagaagaaaggagaagaggagatgaaggggaataattagcttgctttttgttttgctagctgtcttgagttgccctgagagcagaaaaaccagttaaaaatgttttactgaagaagccgaatcgagggactcatgagaggcagaactggaaaaccagatttgggagtaatcctcccagcaatgagacatgaaagagtgctgagcgataaacaaggcggctaatgacttaactacatttaaagacagagtaggaaaagagaatgaggcctcattttgcggaagcgaaggctgcctgagagccagctgcagtaaacactaaagaaaaagaacaatgactgagaaaaagtaatcagaaagatctaagtaatttttagggcagtaatggcttaaactggattacaagggattaaaaagtgagtaacgagtagggcatactgaacactgaaaattcttatttatagagaatagccttacgaaacgggtccaataaccctccctacaatatacaacttaattagtcatcacaggaagtgttaaggtgtataatggaaaagcatccataaactcagtggtgaaatagctatgaattaagtcctggctcaacttcacaccagctctctgaccctgacagtttaacgtctaatataaccctaggatgctaatatcatctaacattcacttttcatgaggattaaataagatgacagcttgcaatttacaaaatgcatctctcttgattctcaccaaaaactatgaagctactaaggaagataaggaaatttaggttcaagaagttcagaagtacccaaagtgtcctttagtggcagaaccaaggctaaaatcagactttcgttatctttctaacacactcccaaaatgtgcatttatatttcaaatttatgaggaaccaattaacatttttgctttgtttttaaaatttatttttgtagagatggggtcttgctatgctgcgcaggctggtcttcaactcctggcctcaagcgatgatcctcctgccttggcttcccaaagtcctgggattacaggtgcgagccacactgcccagccaatattttctgttttaagaaccatcggttcgttcaaattgcgtgtgtatattttaatgtacaaggcttgattggtaactataaccactgtttcaatttacagctcttccctgtcaagagtcttaaacagagcatctttctataaccctaaatctctggcgtgccaccacggaaaattatactactcaagataaagctggtaattaaaataaaaaccaaaacttgaacataacatacaagaacacacatactaaaaggtccatcttctgagtattttgttttcctgaacttaagctaaacgttaaaaaaaaaaagcacttatctatgaaactaagtttgctcagccaatcccaccttctatttgaaataaaacaaaatgattaaactgctacaattagaaataacagaaatcaggcggctacaattagacatctcggctaccaacccagctatgcatctaacaacacagaccaaacaaccctaacttttaagtttcagacgctaaccctctaccctcgccggctggcataagaaacgtgtacatgaggtccagttttaatggtcttccacagagcagaggctatgtttcaatttctactttactgtcttacagcagcaaggagcacggagtggcggtccacataaaaactcaaatgacatgactgtaatgggaaaccctaaaaaccaaggctgtatcgcaatcaccaagtaaacttgagcaaagcgagcctgaagagggaaacacagggcatgagaggacggcagggagaccggccttgtgcggaccccctcagctcagggttctgaggcctgcaggagcccggggcagcgccatcacggcggtgactcctaaataggcttcagcagatgggggaagggcgaaagtgaaagccgcagctctctggggtttttaccctccgttgaaaacgtagggcgaaaatcgcagctgcaaagggcccgcggctctgtgcggttccatccccaagtctctgccaggagccgaatacatggctgtagaggacaacatcgcacggctgcgcctgcggatccgacacttgctgtctcacggcgagatggctgccttgaccggacgttacgccacttccggcttctcctgaagttcgctcccggcctctctatctcacgctagtcgttgctcctggagggctgcacggcggcttgtccctttggtagttgaatcccgcccattccaaaaagcgctgacagggatgtaaagggttttttttgtttgttttttgtttttttccccctcgaagaaaacattggaattcaccccaatggacaaaaatttaagtctgaccatacaaaaaaattgtcagaactatggcgcaacggcaactcgaataacggtgggaacgttaattgtcctggctaataaaaaatgtatataacatttcctatccttaaagagctcacaacctcactgataataaaaagtacaaagaaaacaagcagtataacatatgattacgccacaatgaactacagaagggaaaatcaaggcgtgctgaagtcccactaagaaacaactgcggaaagagccatgtgacaacagtgcatgaactgggagtggcagaactgaatataaatgcatgtgtaaacacaagctgtttgttttgcttagtgttccttgtcattctacacgcttgaagatcagctagcgttcttgctgacaggtaaggaggacgcgcttactgagtgccaagcactgctcaggcactgattctgtcaatctctgtcaatctcccgacagcccaagggtaagcactgttatcattattcaattttacagaaaaaaaatgcgggggagaggtcaggtaacttgtcgaaggtaacgccgctagttgctttaaacaacaacaacaacaacaacaaaacacactcacacatatacacacacacgccatttaaaaatcgatctttcctacgtccagcaagggccaattagagatggctgtggcacggcggccccgccccggaactcctcaagagcttcgcccctccttacctatggaaacacaggaagtgacctatgctcacacttctcatggcctcggccctagtgggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccaggtaacagattgtactcttttctgacggttcgggcgaaggccaccactgcactgaggcctgggggcaatggtggggaagagactaggaattggcgcgcgtgcaggcccctcgggggacgttcctccctttcgtgctgccgccgttccggcctgtaacggccactcggccgccactcccgcctggtgccctactctgctgtgtttcgcaggcagcttcccatcgtacgattgtggggctcagggtactactggctggctgggcggcggcaggcgggacaggacagtcccttgcatcgaagaccctaagtttaccctgccctgtcctgccatccgcttcttctccatgttagaagcagattcacccagatctgtgcccgcctgttttgctgccaacattgagacttaaatattttgtcagaagcctgagacagcgggcacggtagcgcttaagatataatacacaccactttatttgcagggtctcccgtctctcggttcaggccatcatggttttccaaatctctaggtagacttttctgtgaaaagactgtgcttcatttagttatacagacactagaaggctatgcagaattaatttgattgcctccaaaaaatatcggatttgatgtttcaatttccaggagatgaagatacccagcaaacaactcttttctgaggataaattagtgcagtaatcactgtgcggtttcttctgtagacttacttgcaaaaagtggcctgaagccaccgaaggtcctggataaatctctaatcatacttataatggctttaaatcctgccgtcattatctcttgcctcaaccttagattcctgaaacgaaacttccgtcctccagttttactcctctcaaattcatctagtcttgccaaattagatctgttcatactgcacttccgaaattccataactgttattattgcctatgcaataacattgaaaactcctgatagtatgagcccaccaatatgtgctgtctcatctgctgcagtgaccttctatacagtcatactaagcttgttgcctgcatactgcatgctttttcaatctgtctctttctgcttgatttctcttttgtctgaagccctgatgtgtaaattcctactcaccttgtgagacccaagttagatggtccctgctttgtgaaaacactgcgctctcttcacagtgattggctgttagtctatattgtcttctcttccaggggtgtatatgggctcattcatgatcacatactgtattccaggcatagtgctagatgcagagatcacaaagacatgtaggctggtttctgcattcaaggaacttagcttagaccatacctgctgttataatactatgttttacagtagttatttgcatacccttcatattgaacactttgatgccaaggactatatcctcctatctttatatcctcatctgcaggacttctgttattgttattataggataactgtcaaaaaaaaagtatattttaaaaaatatctctgatatatttatttccagaagcagagcttgctttcttttttggtctgtttttcagtgatgagtatgtaggatagatagtctttgggggcctttgccctttcaaagtgatcgtcagagtctttcatacattcagcaaatatctgagtgtctgttctgtaccagcacatgcttgaagtgcatatgcctgaaggatctttggacatataatttgtaactttgagacctctaagttctatgtgagaatatgttgttataaactcatttcagatgtgtagtgagtaaagcgatgatgatttaagaaaagtcagataacaggcacagtttgcattaatgtgttctaaagaggtaaggttattacatttataaaaattcagggctttatctttgtgcggcttttttttttttaacagtttcattacagtaggagcttgataaatgatcactctgaagtatattggattgaatttgatatttacttaattttttgcccaagacattgtagaggatgtaaaattggaatatttaaagatctaaactttgcctaacagtgctgtgtatacagtgcttagtgaatattctgctctgatattacattttgcttaggaattatttttctctaggtgtttttcctcaaaagtttttaatgctggttatgacagctcgattttgagcattttccgattatttaaacatgtaacaaaatgatttttgttttgttggcgattttacatgcaatcgccggaaacatggaaggaataaaactttaggattataaggtaaaaacaaatgtattccaaaatagcttcattggttttcatgtttgtgttttgtatagccatagaactggcttataggactgtacaggttacctggatccttaaattaaactttagacttttttccaaagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcaggtaatatagcaggagggagagaatagggagggcggaaatctgaactgcaagagatggtatcaaaaggcaaggaagggcatttaatgatctgtttttgaaaatggtttaatatgttttttaagccttattttgttgagaagttctattaggctttgaataggcacaatggtgtttatttgggaagtctggaagctaagttatatatttatgaaacacctaatcttttgataaacacttatgagaatgttccaaatgactatatagggtctttgattttgaaaatcaccctcaccaaattattttctagttttatttttccccttttacatttcaagctctcaaccacccatctactttaaaaatttttcagcctgggtgcagtggctcacgcctgtaatcccagcactttgggaggccaaggtgggcggatcacctgaggtcaggagttcgagaccagcctggccaacgtggtgaaacctcatctctacaaaatatacaaaaattagccaggtgttgtggcgggtgcctgtaatcccagctactcgggaggctgaggcaaggagaattgcttgaacccgggaggtggaggttgcagtgagcagaggtcgtgccactgcactccagcctgggagacagagcgagactctgtctcaaaaaaaaaaaaaaaaaaaaaaaaatcaataacttttgttgaaatatacatacaaaaaaactcattttaagtgtctgttttgataattatatataatgtataaattacagaacatttcagttaccttaaaaagtcccttcttcccctttatagtcactctgctggccccaggtaactactgcatctgcttttcaatgctgaagattagttttgtctattctagaatttcatatagatggaatcagagtgtatgcttttttgtgtatgtctgacttcttagcccagtgtactgtttgtatatcagtagttaatccattgtatagctaagtatcactccattgtttggatgttccacagttcatccattctccagttgctcacatttggggtctttccagtttggagctattgcgaataaaagcactgtaaacatttgtgtagactttgaatgcactgtttttacttctcatgggtaaatacttaggagtaggattgctaggtcctatattggtatatgtataactttataagaaactgccaaactgttttttgaagtggctgtattgttttgcagcataagagatttaagttgctccacatcctcaccaacactttctgctgtcagtctttttactttcactctagtgattgcttagtagtatcttattgtggttttgatttttatttgcctgattactaatgtttctgagcaccttggcaagtgcttgtcagccactcatacacaggcccacctcactttactgcacttcactttactgcatgtttgacaaattgaaggttgtggtaaacctgtacccagcaagtctgttggcattatttttccaaaagtgtgtactcacttcatgtcttggggttagattttggtaatttttgcaggatttcaaactttttcattattatccgttattgttatcaaacttttttttttctttttttttgtattttttttttaattttttttttcagtcactctgttgcccaggctggagtgcagtggtgcagtcttggctcactgcaaactccatctcccgtgttcaagcgattctcctgcctcagcctcccaagtagctgggattacaggcatgcgccaccacacccagctaaattttgtatttttagtggagacggagtttcaccatgctggtgtcaaactactggctgcaagtgatccatccgccttggcctcccaaagtgttgggattacaggcatgagccactgtgcctagtcaaaccttttcattattatctgttattgtgatcagtgatctttgatgttactattgtaattattattgaatgccataaactgcacctgtataatacaggaacttaattgataaatgtctgcagcgtgaccaaccattcccccatctctctccctctgcttggtcttccctattccttgagacacaacaatatggaaattaggctaattaataaccttacagtgacttttaattaagtgttcagatgaagggaagagctgcacatctctcatttgaaaccaaaagctataaatgattatacttagtgaagaaggcatgttgaaagctgagacaggctaaaagctaggcctcttgcaccaaatagttagccaagttgtgaatgcaagggaaaagttcttaaaggaaattagaagtgctactccagtaaacccacaagtgataagaaagcaaaacagccttattgcttatatggagaaagtttgaatggtctggatagaagatcataccacccacacatccccttaagccaaagtgtaatacagagcaaggccttaactctcttcaattctgtaaaggctgagagcggagaggaagctgtagaagaaagttttgaaactagcagaggtttattcagagctttaaggagagaggccttctccacaacataaaaatgcaacatgaagcagcaagttatctggaagatctagctgagataattgatgaaggtgactatactaaataatagatttttaatgtagatgaaacagccttctactggaagaagatgctatctaggacttttatagctagagaggagaaatcagtgcctagcctcaaagcttcagaggactggctgactagttaggggctaatagagctggtgagtttaaattgaagccaatgctcatgttctgctctaaaaccatagagccttaagaattacgctaaatctactctgcctgtcctcagtaaacagaacaacaaaacctgatgagagcacgtctgtttacagcatgatttactggatattttaagctctttgagatctgctcagaaaaaaagtttaatttcaaaatattactcactgacagtgtaactagttgtccacaagctctgatggagaagaacaaggagattaatattgttttcatgcctgcttaaataatatatccattcttcagcccatggatcaaggagtaatttcaactttcaattcttactatttaagaaatacagcagggcatggtggctcatgcttgtaatctcagtactttgggaggccaaggtggaaggatcactcaaagctaggagctcaagaccaacctgggtaacaaaacaagtccctgttgctacaaaaaaaaatttttttttaattagctggtcatggtggcatgtgcctgtagtcccagctacttgggaggctgaggcgggagggtcacttgagtccagaagttaaaggctacaatggagaccctgtctcaaagaaaggaagcagggagggacatatgctgtagctgccatagatagtgattcctctgatgaatctgggcaaagtgaattgaaaaccttctgaaaaagattcaccattctagatgccattaagaatgttcatgattcatgggaggagggtgaaatatcaacatgaataagagtttggaagaggttgattccaaccctcgtggatgactttgagaggttctagacttcagtgctggaagttactgcaggtgtagtggaaatagcaagtgaactagaattagaagtgaacctgaagatgtgactgaattgctgcaattttttgataaaacctgaacagatgaggagttgcttcttgtgagtaagcaaagaaagtggtttcttgagatagaattgactcctggtgaagaactgatgactttagaatattacataaacttagttgataaagcagcagcagggtttgagaggattgactccaattttgaaataagttctagtgtgggtaaaatgctgtcaaatagtatcatatgctacagagacatcttcagtgaaaggaagagtcagtcagtgtggcaaacttcgtcagtcttattttaagaaattgccacagctaccaccctgatcagtcagcagccatcaacatcgaggcaagatcctctgtcagcaaaaagattatgatttgctgcaggctcacatgattgttagcatttttagcaataaagcatttttaaattaagttatatacatattattagacataatgctattgcacacttaatagactttagtgctaacataacttttgtaggcactgggaaaccaaaaaattgatgccgcttgctttattgagatggtctggaacctaacctgtagtatctccgaggtatgcctgtatcttcatttgtaatatgtccttcacatcttttgcccttttttattattttatttgttgatcttcttttatggagttgtcagagctctttattattctgtttaccagtcctttctcagatgtatgtattatagttatttttttcccagtctggcctgccttttaattttctcaatggtgtctttcaaagaacagaagtttttaatttttccgaagttcagtttatccatttttcttcatgtttatccactgtgtggtattaaagaagaaagcaatgtgtataagaatagctggttcttccgtaattaatgtttaataaccccattattctccgaaggcatctgtctttgcacacctgacctgctgttccaccaagaaagttccacaaacacttagcagcagccagcctaacctgtttttctccttgctttccacagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcagtgagtacttcgtgttttatgtttcctcccacttaggagtccctttgagttatgttcctgctctgttttcagatggatccttttattaagggagggagtggcactaacggtaattgtgtatcaaaatttgctttatctcacatttgggaaagggaagcaaagctatcttagtcagtgtcctcagtaaaaggctcttaacaggtttagaaatgtggtcatttgtgtttacatacctgagccaataaaatttaatctgactttcactgtcgttattattatattatagacatttccctgtatctgatatcgctaaatcacaatgttaggtagtctctttcccttatgctattttaggtctttagtcacaatatcagtataatttctggtagttcttgttttttgtttttactatgggtgctgcatataaatctttgaaggtctgtgtccttcccacaaaatgaagacgactgtttttgtcataaatggatttttctacctaaatgaagtgggttctatatgtaacagtgtagtaggggtaggaaataatttcatcttcctgaaaaaccagcaaatatttccaaataattccagtcaataagaagtgtatagcttttcattttagaaagcttatgaccaaattaaaaggttacttgcagtctctgcatctcctcagttttcttgtacagataccttcctccttcatactccctttagatctagtatttcctatttgcatttattcaccttgttacatatatggttgttgtttataagctatctctcatcatttttggaactaagtggtgtgtaatcgtggatgctgactttcacccaaagacctaaatcttgcctccacaattttgtttgaccccacacacaattttaaaaacaaagtaattttagtgattttagagagagccctttttagctcacccttgtctataccactcccatgtgtccagcatgcttgtctgactcccaggaatatttaagtttgcatttctgatttaaataataaattataaacagtacagtcaggtgtttgtttcttgcgagtgcctttgctgttctgatactccccagagcatccagtcatccacattcctgaatttccactatctactaagaaccctcccgggtggtagttcagtgccctctccatcttgtaggcttaagagggattaaggtaaatatttaattaatgaaaatatataagaatacatttaacaattatgtgactaaagttgtgatagatatactaaaatctacttggtatagttcataagtggacaaatgctaaaggcaggtgtgtatacaagggtgattggaaggaaatagatgatatggaaatgaaaacattcattgtgtggatcaacctaattggctttacagttgtgtatcatagactgtacaagaaaaagaaccagaagcaacaatgagctgaaacctattgtatttgaacctatgtatttgaaatctggactcgatattcttgggatggtgatttccaggtccatgcgagacagttgttgagcagttaattgcattcaaagggcattgcccatttcaactatatatactttcataagcagaaaaatgtataatgaaaatgtgggtttgttgtttaaatttttattaaaatttctaatagagttgctttttagtatatctttatccttgtataagttattcgttaagtgatttaagaacactgagaaatgaaaagggtcagtggacccagatggctccatttatccttatttactgagagttaattagaagagaaagcagggttttgccttttttttttgctaaagacacttagctcttgtttttcaaaagatacttactttgagagaactgggcagttcatgcctgcttgttttcattataaatagttacttaggaatagggtggtggtggtagcttttcagagctcacagatgagaattgagtttgtctgtgagaaggctaagggcaggctctggagacagacagactcaaatcctggctcctccacttgggagccattgcgtcctgagcaagttgcactctacctttaagcctcagcttatttatccaaatgtgggaatactggtaacttctacctcagtgcgttatatgtattaaatggaataatctatataaaatgctcaacatgtgcatgatacttgttaaacaataaatgtgagcaattaaaaaaaagtaaagcctggttgaaataatcagatgtctgcataatttctaacgcctcatccaatgaaacttaagtaatttaaatagtcgtgttttctttttaaatctcttacagaaatattgtatccacagtgaatcttggttgtaaacttgacctaaagaccattgcacttcgtgcccgaaacgccgaatataatcccaaggttagatctattttaatgtatttcttttttttttcttttttgtctcctctgccgtgtctctatattttaatgtatttcacgctataaaacaaatgtctgtagatcaggccaggcacagtggctaatgcctgtaatcccagcactttgggaggctgaggaaggagaatttcttgaacctaggagttcaccaccagcccaggcaacatggcaagaccctgtctcttaaaaaaaaaaaaaaaattggccgggcttggtggctcacacgtgtaatcccagcactttgggaggccgaggtgggcggatcatctgaggtcaggagttcaagaccatcctggccaacatagtgaaaccccgtctctactaaaaatacaaaaatttgccgggagtggtggcatgcgcctgtaatcccggctacttgggaggctgaggcaggagaatcacttgatcctgggaggcagaggttgcagtgagcggagattgcgccattgcattccagcctggcaacagagcgagactccgcctcaaaaaaaaaatctgtatatcaaagagtttgtgttatgcttattccttgacaccaataaaatgaagatctaaagtaaaatgtgcattgttttgtatcttttattgagtgtctgtgatataagaatccctgggagtacagcagtctataaaataagctaagttatatatgtattgtattgggatcatgtgaagaattttgtatatgtatagggatgatgttagccagctatagtaggcaaagtaatttggataaacattagctgggttgagagaaatgttaagtaatggacttagggtgcattttaaaatccctgaaacataatgcctgagatctgaaagacagctaagggtctgaaaatcaccttttaaccactcataatgagtctgtatgacatgtagcattctaagaattaatctttcatctattataatcacatttagttgaatacataattttattactttacgttcttaagtgatatttaaccaataaaaatagtagaggaaattctggaaattcaaaatagctaggcttttcctgggacgtatataaactactatatactgctagcttttttagatgttgataaaatcacagggaagacatagagcaggttttaaactaaaattgttaaaagccaggcatggtgactcagacctgtaattccagcactttgggaggccaaggtgggaggatcacttgaggccaacagttcaagacgagcctgggcaacatagcaaggccttgtttcatcagaaaatttaaaaaattatctggggttggtggcacacacctataatcccagctacttgggaggccaagacagaaggatctcttgagctcaggaattcgaggctgcagtgagccatgattgcaccactgcactccagtctgggcaacaaagtgagactcttgtctctaaaaaaaaaaattaataaaataaaaaaataaaattgttaaagcaatctagtttgtcaaagagtcgtcttaattagaaacatgtaggtttttattgtataattaaatgtattaaaatatttaagttgtttcaaagtaattatttgctttttatcatgtacctaataactgaggccattaattcaacccacagttgaaatattttccccttgagttaccaccttagcaagaaaattttctgaaagaattaacatgtttcaagcataaaaagcagaaaataaaagttaaaactgtgtttttttcctaatttgcatttatgtgtttaatacattaatattgtttctaaagaccaattgaaagcatgattttacttcattacgtattgataggcttgtaatctgatttattaattccattaaggtagaaaaggtttattggtttatttgcctcaaaattcatattaataaaacaaaatgtatcagagaagctatagtcatgataagcagcaaatataaagtagaaacagaagcacttgtatttattgagaacataaccaaattttgcaaacatttctcttgatggaatgctcatgtgaaagaacatacagatttggtataacttagtcacaattgattattttctgctccttatgcaaaggaatatttgttacatgtggtgtatgcaaatcctttacagatatacagaaatacagaacaaatattttgataactagatgtactatgtccttcctaccagttgtgatttttttgtcaatgggtggttcgcctaacaacattgagcagtttggcatgacctcactaatgattctctctgaccattgtagcggtttgctgcggtaatcatgaggataagagagccacgaaccacggcactgattttcagttctgggaaaatggtgtgcacaggagccaagaggtagccgtaagaaattcattcttctggtctatgggttatgaatgaaaaggtgatatctcattgtttttaggttattaggttagcactttaacatgttattattgctttcttataaaaaccattttaatatgattctattaattatttttatttatttatttattatttgattctattaatgttagatagcagtgatttcattttcttaaaaattagatatgggcaggcgtggtgtctcaccaaggcgggcaaatcacttgaggccaggagttcgagaccagcctgaccaacatggtgaaactccatctctactaaaaatacaaaaattagccaggcgtggtagtggatgtctgtagtcccagctacttgggaggctgaagcacgagaatcgcttaaatccgggaggtggaggttgcagtgagctgagatcatgctactgtactccagcatgggagacagaacaagacactttctccagaaaaaagaaaaaaattaggtaagatgtaatacaacatcagaactattaataaaattccctttatgtgaaaaatgttgtaaataacacaaatacatcttgaaatggaagaaaaaattgatcaagaattaaaacacttctaagctaatggtgtaagggctttgcagaccttattgggcctggcagcgtgacagcatcacatgtgttggctgcagaaacctgccttctcactggaactagctttcattaatagtgtttgagttgtgcagatcttaaggaatgcacccttgttataaaatgtcattgcctatattctccatctgaagtgatcctgtctgaaggttagtactctgcggccctgactgttctaaacagagcttatatacttggtagaagtcaaaaactagggggaaaattagtgacattagcttcataaatgaactgaacaaataaactaaaactttttaaatgaaagagtattaaatgtacttggaggtatcaacacatagaagggggctgtggatatttttgcttattctgaagtttgaaattgtctttcagtgatgggaatgccattggtgtggacattctggctcctgatctccgaggtttttcagaatgcaggacaaggatgtgttcttgcctttcacttccccttggccacaacatgcagtagtaacctctttaattaagagcgtttttgtttgcttgttttcccctgcatggaacatcagaaacttttggtttatcaaggcaagcttttcatgcagcatttagcctttttgtcccagagcatctgaaaactgaatattgtatatgtagttggatgactatttcatcaagacaagaaaccaccaatacatttacctgaaatttaaaagcgtagcatatatatatatgcttgatttttgttcttcctgatcccctgcacctgatagtctctttatggtaatattttcacattcttttttgttgttgttgttgtttttgagatggagtctcgctctgcgcccaggctggagtgcagtggcatgatctcggctcactgcaagctccgcctcctgggttcacgccattctcttgcctcagcctcccgagtagcagagactacaggtgcccaccaccatgcctggctaatttttgtatttttagtagagatggggtttcactgtgttagccaggatggtctcaatctcctgacctcatgatccgcctgcctcagcctcccaaagtgttgggattacaggtgtgagccaccgtgcccgacctgcctgcctgcctttttctcttttattttttctttttttctcttctttctttctttccttttctttttttttttttttttttttttttttggtggagtcacctaggctggagtgcagtggcacaatcttggctcactgcaacctccacctcccaggttcaagtgattctcctgcctcagcctcccaagtagctgggattgcaggtgcctggcaccatgcccagctaatttttgtatttttagtagagatagggtttcaccatgttgaccaagctggtctcgaactcttgacctcaggtgagctatccgccttggcctcccaaagtgcttgggattagaggcgtgagccaccatgcctggcccacattctgcttttcttatgtaagctctgaactgctaagtcgtagtttattcaacaaatgacataggaatgtctattcatgatgagtcttggtataaaagaggatagaattagtgaatacattgttcaataataaatctcatcaacattttctgatcaaaatgaagtttgttagttttcctctcagtagaaatgcatgggctaaaatacagaaatagtgatgactgatgatggtgataattcacatccataaaatctagggctacaataatttggcggattgaaaggtcattttggcaggcctacagttttctgtcaaggatccaggaatactttataaggaattgtgaatgcctgtcagtcttttctcctattgcaagaaggctgaccagtttacactttattagtttactgttttggactttttataagttattagtctaaataagtattttagctggctctgagtatgaataactcacttttttcctttccctagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtaggtaagtctgaaatgtattatgattgttattggcaacagttcatttataatctaaacattgttcagaataaaacacatgcaaaatattcagtatatgagaacagttgacatggttatagttgtatgtattcttgcattgtcttcctgatgttctcagtcatatttatcaccctcaccagcctctgcttcccttatcactttgcggtacccataactcccctttactggaatgaatttgattctacttctgtatgttttatcgttttattgctgaatacacttggaatgcatgaattgaccctaaccttgtatcaattttttttcccagtttggatcttctcttttagtcaacattgtgtcagatctaccagcaaagtgtgaagttgagcgataggaacaactttctaattatcttccctgctacttgcaggtgaagactcacaggcaggcagccctgcccacctcactgcttcatctcatggtcttctggtgtctgttcacaggcacattagttctgtgtgcccctggggctcacttggttcctcctgccctaggcctttgcacttgccacttttatgcctagtatgctcatttcccttttcacctaggaagctcccacttgagttccatatgtctacccattccactcttcctcagagaagcctgtcctgaattttgtcttaggtcagacacacagaaacagaggcatcctgttttcagtctctccgaactgagaaaaatgagattactaggcttagaagaatatgtaccaggcctggcctggtggctcacacctgtaatcccagcattttgggaggccgaggcaggcagatcagttgagttcaggagttcaagaccagcctggccaacatggtgaaacctcgtctttactaaaaatacaaaaattagctggacatggtggtgcatgcctgtaatcccagttacatgggaggctgaggcaggacaatcattcgaacccaggagatggaggttgcagtgagccaagatcgtgccactgtactccagcctgggcgacacagcaagactccgtctcaaaaaaaaaaagaatatataccaatagtccattcagtcagacagcttaatcaggtataggttaattctcaggctagtatataagtttgattaaatttcctgaccacaattgtcagctagagaatatttcaatttaaggaggtaagatatgattaaaagttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaaatccagattcaatagaaatagggtaaagtgataggaggacaaatagccttccatccagtggttatcaactgacgactacaagtcggcctcacttgctttaattattctattctatcctttgatgctgcttgaagaactgtgttttacctcttgactagtttgtttattcagtatttttccttgtacaggtcctcattttatctaaaagcacacaaagctcttgatttctaaactttttgcaattttccttctagttatgagccagagttatttcctggtttaatctacagaatgatcaaacccagaattgttctccttatttttgtttctggaaaagttgtattaacaggtaagttgtaacaggaagtagtatctgaaagtttgtaagtgttttgagtatggcattttctcagtgctgaaaagaaatttcagtgttcggacagtgggctagcttcttgtacaaaggcctcccacccaaagtctgatgagaaacgtgcccactaaaggcacagtgagagcagggaagtctgaccacagctctgcaagcagacttccatttacagtgaggaggtgagcattgcattgaacaaaagatggcgttttcacttggaattagttatctgaagctttaggattcctcagcaatatgattatgagacaagaaaggaagattcagaaatgagtctagttgaaggcagcaattcagagaagaagattcagttgttatcattgccgtcctgcttggtttatggcctggttcaggaccaaggagagaagtgtgaatacatgcctcttgagctatagaatgagacgctggagtcactaagatgattttttaaaagtattgttttataaacaaaaataagattgtgacaagggattccactattaatgttttcatgcctgtgccttaatctgactgggtatggtgagaattgtgcttgcagctttaaggtaagaattttaccatcttaatatgttaagaagtgccatttcagtctctcatctctactccaacttgtcttcttaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttataccttgtaagagtcatgtgatcatactgttttctacaaagttgtattttagatataatgcctgaaaccattttggtgtttgcttcagtcagtatttcattgtatgctgcaatgaaaacagattaatgatctgagaaccttccatatattgagcaactcctgttttctaggtattttgcatacaatgcctggaatcctcacaaagcttcagttacgttttgttcctctgttggaggtgaggagataaggaagccccagctgagggacttggctgaggttacacagctagtaagtggtaaaaatgagtgagtccttcaggtgtagaagctggtgccctatccacaggctgccaactctctgcagtaacttttttttgcttgttttgcagtttttttctcatggactatcaggtggacatttgtgggttcttaggttttattgttagagtggtttgttgtttttaattgtaaaagtacatcttcagctgactcaggaataaaatcagaaaggggaggtccttccttcctttctcttctgcctctttccccaagataacgaccagattagtgggtatcttctaagccctgttctgtctatcttctgggcatggcatttgatcccatttttggaaaaaagaaataatacattcaattttatagctttcccttttttcagtcaatatatcataaacctatttccatgattgggaatctaggatactcttcttaggtaccttcacttactgagctattcctgtaattatggtcatttacatgacctctagtttttcaatatcatcaacagcgctgcagggaacatccttgtatgtgtatttttcggatgagtgcaggtattcatgtagtaaactttcctagaagaggaactaaagactatacattctgagttttaatcagttgataccagattgcagtccaaagagaacggtgcatgaaatgcccttttcttgcattttccaatcattagtgatgccaataatgtatggattaattggaaagacatcattccaatattatctcctatctaagaaagaagtatctcttcatgtatgtaggtcttatgttcctcagtaaagttttgtactttttttcacacagggcttttatatttcataagtattacttccttaattcctaagtatagtatcatttctgttttattactggaagtttttcctaacactttaaaagttattgttgataatatttttcttattccgagtttactgaactcctattactgctgatttagttgattgcattgaaagttctaggcatgtaatcatctgtaaatagtaattttatgttttcctttccaacatttatttttcctatcagtgcctaggactttaatgtatataacttaaaaaaaacatctcttagagttgtagctacatatacaggaaatctaacaaatgtgtagcataatgtattatacaaaggcagacacccttgcagccaccaacaaggtcaagaaacaattttgctgcctgtcctagaagcccctccttatggtcctatccagacacacacttctggcttccctcaagcagtgactattatcctgactctcacgcatttaaagataattgaagttcctcgtccatctcttttctttccaatttacaggccatttagtgtgtagagcttctcatagtctggggtttgctagttggaaattcatggtgtagtttccctattctctgtatttcctgcaaattggaagctgctgtgtaattcctagatctattaattcattagtgggttgcaaaatgacattttagtcatttcatttctttttcatttattaatttgaatacttttataaagtgttgtgctccatatagcagaatactttccccttttaagttttcaagataaaatgagttcatattaatatgtccaattcaaagctcatagggttattttaccaattgtatatccaattcaaattcaaagcttatagggtttttatttaaccaattctgtattacactcttccttctacactgagaatttttaattcttaaagacataggggatgaggaattagaatgtcccataattactcatttactttacgtatttactttatcattactttatctgttatatgtgcaattttttttgagacacggtctctgttgcccaggctggagtgcagtggcacaatcatggtttgctgcagtctcaaactcctgggctcaagtgatccacctcagcctctggagtagctagccaggactacgggtgcacaccaacacacccagctaattttttttaatttttgtagagacaaagtcactcaactgttgcccaggctgttcttgaactcttaggctcaagccatcctcccacctccaccataacattcttaagagtaacaaaaacactatcaccaatatgattgccaaaaacacttggaactttttttttttttgctgtgatatctgaaattgccaaaggatattcagtatctgaaataaaaaggcaaagctgaatatgctgctctctacagcagagggagctgctgtggctggacagtatctgaaccaagcagatcttaaaactttgtaggtgttgagaaatggtggatgcatggactggcaccgtctgtggagccatgattatgtaggtgagacttgctcattatcttgtagtgttttaaaatgtcttcacatttctaaaggcaacttgcttaatgcattttttaatttaaattttttatgttgtacagtttattttaaatatagttgctattttttaacacagatgccaagtcggtgctgtgagattttctttctggtgatttggaccagtttgtctccctcttgatatatccatcccaaatggaaaggccctgtaaactgttacgatcatctccagaggttaactggaatatacaccaatgacagcttgcctgggtatgccaaaatacctgcaagaatgtccacatcatctggtgatgtccccaaataacagtttttaccatagaaagatcgttaacatgtttgctttaaaagtcattagcagtcataacgtacttacagattctgcctataaggaataatacataattttagatataaaggccccactagtccaggtttccttatgccactgtgcttcctactaagtgttgcgaccagctcttgtcactagttgatgacaacttactccagtagccacagggctgtgacaccatagttataggtgattttcatagatttagccatcccaggttcgaaactagtatcctctagctcttaagtagctgataacctccccatgggagaaactccatactgcagtttcccatatggtgctatgtataactatcttatacaattaatacaaattgcatatgtatacttatataatatggactactaggacagaactttttaaattacaaataaaatagccaagtagacaattacattagcaagtgatgttacctatgaaaacgtgaggatttatggtggcaatgcatttcagttaacagggatgtgttaggggacaatgtgagccaatgtagattaaggaaataagcctgagaaatttatcagaattagccgtcagtattcaagcactgatcaacagcaatgtgtcttaagggcaggcatcactggtgctgagagaactgggaattgtcaactgtgagctgctaggggatggaagaaaccttagtgtagtcttaggagccgcttgcttaaacagatgtatcagaaacataataggccaagggtcagccctttgaaaactgacttcagggccttcctttcctcaggctgctgcctcctaggccagacccttattttggcttacattccataacccttgtatgtgcgatagggaacctgtatacaatgctgacacggaaagggaagaccatcgccttttgcctttcagtgtctcatctgtaagcagggccgctggctgaccaagatcagttctgaaggtccagcctctttaaattccagttctgtgatcacaaagccactgttgttcctcatcctgccaactgtgatactgctgcttcagaattactgggtttcctgttcatcatactcaccaacctgaggtttggtatttctcaaatattctgggcttccagtacatactagagcctgtgataatcagctaatgatcagacaagtttgttgggagttttacctaagtatttttgtgttttaaaaacctagggtgggaaatgctcagagtgagatggtttgacttcattaggcatataacccatttttattataaaaagaaatgcacatataagtaaaaagaccattttagttagtcccaccattcgttggtaaccagttcactaagtgtacatctttgcagatttctgtgcatacatacaaatatttttacaagaataggatcataccatgaataccacctataatggtatgtctgttgtcaatataggtgttataattaagactgtgtagccttcctctgtggatgtaccaaaatttatttaattccctgtcactggacacttttgtttcactaataagtagacactgtgtaagcaatctgtcaacatctctgcacctctatttttggtataagtatttccttaggataaaatcccagaaatggaattgcaaggtataaaagattattaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctgagaagagggtgacacacagttagaaagctgcttcacagcagggagcacgagaccttctcagccaggatgattatagggatcttggtctttcaatcctcatactacaaagcaggattatagacattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctaactcaaagagtgaataggcagaatagccacctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaagactcctctcataaagtatatagtcaaagactttaattactagaacaagaaaggaaggtatacattatttaaaataacaaaagttaacagaggcactaataataatgacataaccacactggaggtggagagcagtgtagatatcctcattgtcacagaagtcagtcaatagaccgtgtctgaaaactaggaaacagaaaaaaacaagacagttccttccagggaactagccccaaggtgaggcaggaaactgatgattttcattatagggtacccttccatactgccatgttgacccatgtgcacaaattaccttggtgaagtttttaatgtttaaaaacaatcatggtgattacacactaaatggtccttatttaaggtcatacctggaattccaatattctcttggcaccacaggggcaatctggaatatccttttcttgaggaatattttcaccagaaatccagatgggggcaatacctctgccatatctaagaatctaaaatcaatgaagatcatgttcaaataatcaataccttacctataagttgccaatggtaacatgctatctactccatgaatgttcctactcttgatgtagcactgacccaaaaggcatgtcacagttcccccatcagacctggctgtaccagtgtgccactaatgccttctcaatcacctcaaagtgattatttcagtttatctgactcagagggcatcaaaatatatctcccagatgatgcttttactacctaatgttggcaacttaatcctatgaatatattgtgaagggactaagaatgagcctctgctctaattgcagaattctgcccagagtctgtgcctaccttcatagttaaaaaattttaggagggacaaataccaagtgaaacatagtgttttgaaaactactacaaacataagtaaatttcactgtaataagcttcctacagcaactgagtggttttctgtattttgtctaaaagcatatgcattgctaaaaactgccttagtgtttaagacctagatctattcttcctgtgtatttatttgaaccagtgactggtttatgggagtttagttttctttcgtgatttacgtttatggtaggggaggttaaggagaaaaatgttaacatgtcacattttacaagccaaagttacctgttggaaatgggcaaaaataaccttttttctttctggcgggggggccaatggtgcctaaacctcatgtaccttaggcaacatctcattcatctcccatccctgatgcttgctttagaaaatgaaccctgtatgataaacagtataacctttagtcttttagtaactattaaatggatcagcactgcaaaacacctttctacatggcccatctgtgtgaggaactcctctaacaagataacaaaagcctgcttttataggctcctaaggaacagactaatgttactatgaagttatttcttacagattatactcataaaacatggcctgaagagaacacgatgaggagctatgagctccactttacctgttctggttcaagggctatctgagttttaaacttctgaaaaattttatcttccctggattcatgttttgccatggaatccagttcttcctcaagtgcttcacctgaaaaatcaacgtaactattatgaaaaacaggagtaatccccacaacttgacaattcacacatggagaggggacccacttttaatcagatagctttccctatttattcactcattcaagttggaccatctgaatttccaggtactccatccaactctattatatggacttccatttagtgcatctccttaaagcttcaaaataacagaatggtcaagggcttaggactgcccagcacatcacaggacacccaacaaatgtgagcccttatcattagtatcctcagctggtaggctcactcactcagtcatcaagtgttcatttctggcctggagcagtggctcacgcctgtaatcccagtactttgggaggccgaggcgggcagatcacctgaggtcaggagttcaagaccagcctggccaacatggtgaaatcccgtatctactaaaaatataaaaattagccagacgtggtggtaggtgcctgtaatcccagctactcgggaggctgaggcaggagagtcacttgaacctgggaggcagaggctgcagtgaaccgagatggtgacattgcactccagcctgggcgacagagtgagactccgtctcaaaaaaaaaaatgttcatttccttctccacattccttcctgggattacagccaccctaagccactgctgtccccaacagacccgtgtctctaagtataaccattagtctttgtaatgtacgttaaaatagaactgatataccttgggtcagagaagctaaaataactgctttgatgaaactggaaaggcactgatggtgttcacttgcaccatcaggtctgatggaggaagtgtaggatgccttcagattgatgttccatcaagtatacgtggaaagtttcagtataaccgttaggacactgtaaatgctgttccctcaggccctactgcctcctgccaagtctcaggtaagacacagctacctccaggaagcatttttctattcaattctccttttattttagaaaattttggacatacagaaaagtggaaatactataatgaaccgccacatatcattaatcagtttcaacactatcaagtccagtgtttcctttctctgccacttccacctccattactctgaagtaaattccacacatatcacttcattcataattaagttatgtacccctcgaaggcaaactctttccttttatttaccaatttgaaaatgagtctgttcccaagtatcctataaagatgattactgagtttttttaaagtatcattttgaacccattaaacatatctgatgcagttagcgtccttgtggatgttcaaactgtccatcttttgcaagcaggagccttttcatgttgcttgagttctgacatggccctagtaatccttatccttaatctttgatatgaccatgttcccacattatatgaacgtttcctgacctagttctggaatcaaccacctctccaaagagcctggagttccttttagagagaaatggtacgtagacacaatcaacattatcttcctcctacgcccaacatctcagttctcagtaacaccaacataattactcgtttcctttccccccaatacacacacaaccatctcaaaataaaagcaacagtctagtaataacatgtttattcaaaatactaacactgttacattcttttcattctcagggcatattctactagagatgtactgtcctatgttttgaagtcacctggaagagttcttagtgtggttatatgactacatcaagagttttttacttttgatgattagggactgctttttaaaacttactttactccataatcttaaaatactcatacagttccacagtcacatttacactaacaaggcatatttgaagtccagctttcatccttgatcctgctactctaggctctcctttctcctaaagataagcattttcattatgtatcatgtttatcgtataggcatgaacacacgcgcggccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatggctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaaccgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagtattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaaatgcctatatggtgacattattcagtgattcagacttcacagccttttttttttttttacaaaggtgttccaggcatgaaaaattttaaagtactatacctttcctaattttacctttaaagttgtcctggaaatatctgggttgacaaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatacagagaaaagttttatcttcaaacaaaacagcaattcacatattttatcctctgcacgtaaaactgaaaataacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacctggtacccactgattaaaagctgggggttaccaatgcgcgtgggcacagttagaagcttatgtagcaaaaatgagcacatcctggaagggcccgggagaaggtgctcctggggcagcgcggagagggagctctgaggctggggcggcagcggtgcttgccgccgtccccctggtcgctcccggaattaacgccgcgcacgcgtcggaggcatggccccgtcccgaccccgtttggcggctcacctcgcaggccggcacagcacggctgctcgcggcagcagaagaggaagatgcagcggtggaaggcgtccgggcggccaggcagcggcgcatacacctgcagcaggaaggagagcgggcggccgcacagctcgcaggccagggcctggggccccggcagcccggccgcgcccagccatgccggccgcccgcccaccttgctggggaactgctcgctgcgcagtcgccacgccggcgccgactcggcgaagcccagctccacaggcctggccccggcggcagccatgcggggcgcgggctggcgtggggcgcagcccacagctgggtcggaaggcggaaatcgggcgccgggccggaaggcaagaggcgggcacctttccggaggacaggaggcggaaacgcgtctgacgggagcggttgcaggaccaatgcgagggaacggggcagaggaaacctctcggcatcagccccgcccctggcgcctctgcctccgagccgctttcctggtgcctccgggtgctctgggatggttctggtctttgggagagtggcagctggtgacggcgctccgctcacctctgcacatgtcttgctgtgggcctgcgggtggccgccagggaggcagagccctcccgcaaaccttccctgctggtgtccacctcagggtgtgggaaacctgtgcgctggccgagtgctaaccaagagtaggcagtgaaagacaaatgaaggttgaacaggtaaagtgaggaccctacagcggaaaccaagaatcctgtgtgcctgagagtaatgaagaagcctctgcagaagagtcttttctgtcagtcttaaggtctctgttttaatgttagtgctggcttgctgtacctgaattccaagggaggagtgtataatgaggcatggccaacccccacttcccatcattgcctgaactagtttttcaggttaacttcagaatgcccttgggcaagcagagggtccatcagtcggttggagggtttagaattttactgttggtttgcaaaggtctgaaagaaacatgtaccacctgttctctttaaggagttctacttaggaggtttcatttacataacaagaccgtggttgtcagccaggtctccacccgcataacctgttatgccacaatccaaacccccattctgtaacctcaagatggtatataagtttctgaaccccatttggggcttcagcaaaatcactctggttctcccccatgtgcatgttaataaatttgtatgccctttctccaattaatgtgccttttgtcagttgacttttcagtgaaccttcagaggacaaaaaggaagctttcccttggctactacagtggctttaatggaagtaaagtcatcaacaacatttatttttgacaaaatcacagtttagttggcagtatatttgtttgtttttgttttatttgagatggagtctcgctctgtcgcccaggctggagagcaatggtgcgatctcggctcactgcaacctccgcctcccgagttcaagcattctcctgcctcagcctcccgagcagctgggtagcagtatatttgtaatggtacataaaataatgtctgtttttaaataaacatttacattgtaaaccaaaagttaactctccatcaatttttttttttcttttttgagatggcatcttgctctgtcacccaggctggaggagtgcagtggcatgatctcggctcactgcaaccttcgcctcccaggcaagcgatcctcttgcctcagcctcctgagcagctggaattataggtgtgtgccaatacaaccagctaattttcgtatctttggtagagacagagtttcaccatgttggccaggcttgtctcgaattcctgacctcagttgatctgtccgtctcagcttcccaaagtgctgggattacaggcatgagccaccacatccggcatccatcaatttagaaagtttatttcaccaagattaaggttgcacccgtgacacagcctcagaaggccctgatgaccatgtgcccttggtggtcagggtacagcttgcttttatacatgttagggagacatgagacatcaatcagtatgtgtaagatgtactttagtcaggtaaagcgggacttgaggtgagggcttccagatcatgagtagataagaggcaaaagatcgcatttttttgagtccttgatcagccttccactgaatacacaatttagtctggctcagtgaattatcatttttacgtaaacaataggggaggggaagcaattagatatgcatttgtctcaggcgcaccttaaagggataactttgagttctgtctgtcctttatccacaaggaatttccttgtgggcaaattttaagggaggtacgtagcctcttatcttggcagctatcttatttaggaatagaatgggaggcaggtttgcctgacatagtttccagcttgactttaccctttggtttagtgattttgtggtcctgagttttattttcctttcacagaaattataccgtaaaagtaattgaagaaaatcacttctttccccttccctcaactaggccttgaccattttaaataaaatcaggatttgctgaaggtcaacaaatttaaccaagttcagttaaaacttaactctgaatctgtatgtccctggggtcttttccagtgagagatgtctaagcatcattccaagcttttctatactaactggcctatttgtatgtttcttattttaggattccttttgttcatgtgtatttttattaggcaatcacccatttcctgtaggtttccaggttaatatatttttcttattggaattttaatttatcctctctagttttctacatattttttttttctttgagacgaggtctcatatgttgccccggttggcctcaaactcctgggcttaagcaatcctcccaccttggcctcccaaagtgctgggattataggtgtgaattactgtacccagcctagaatccttagtcctatatacttttgctgtttttttcattgccaacttgaaataataaaaagggtcagaatcctataaaccaaaaataaaataaggccccccaaccctctgaatggacttcctcctctgacacagatcttttacaatttaacctgtatgaaccccaaaaattggagacaggtctcagttaatttagaaaatttatcttgcgaaggtcaaggacacacgattatgacagcctcaggaggtcctgacgacatgtacctaagatagtcagagcacagggtggttttatacattttagggagatataagacatcaatcaacatatgtaaaatgaatattggtcaggaaaggtgggacaactcaaagaaaaaatgggacaactcgaagtggggaggggcttccaggtcacaggtaggtgagagacaaatggttgcactcttttgagtttctgattcacctttctaaaagaggcagtcagacatgcatttatctcagtgagcagagggatgactgaatggaatgggaagcaggtttgccctaagcagttcccagcttgacttttcccattagcttagtgattatgggattccaaggtaatttcctttcacatttccccccttttcttttttaaaatattttggagaaagcatttttgaagaaaataagtttctgttcccaggttttatctgctctctcatggctaggatggttttttcctagaagggtaggtcctgagttattaggaaagctcatttttagaaggttgtgaagtctaatatcctatcaagagaaaatttggggaggaagggagaacaataagaacaatcttggaaaattgatctaggccacattactctgaagtccatacatcagtaagcaggtatgaaagtggcttatgtatgtaaataggttcccattattttcttctgaagtttaagttgtctacttcagttcacagggcttcacgaaagttagttttaagtgacttagtttagtgacagcttagttttaagtgactccaaattaggaaaaatggggaaaaaaagaaggaaaaaaattgaaaacattattttgaagacttgtagcccacaaaaattagaatttggtccaaactgtagaaaatgataaaaattgaaaaacattaggcaagactagaatctaacaactggtggactatagttttccagtctctagtttcccatttatactaaagacaaatcatgataggtttgccttattatatttggccgaattatttgtatacagtgcagcaagaataattattttttaacattggcttttaaattggctttgatggaactttgttccatagagggtatttcagataagactttttaaaagctgagcccagccatggatttgtgccatcaaatacctgtgagtttggtgatcctctcctcttgaggttccaagataaacttgaggctcctgggcctgtcagaaagtgacattctttacttaccacaggtcaggaaccctgtacaggagctgtgtagacaaagttatgaggacggtttttccaagggggtttaattggctccgtaagtcaagtaaaagcattggtaaacaaccagtttccccaattgtgtcctgttacaaatgaaaacagattattagtgcacttatgcaaataactgtattgtcataagttaagaatacttacagtttccaaattctggagaaatcgggtagagagaaccaaatgtgctccaaattttgttcataggagtatgtgttactcaattgttaaaagctgcagatagcctgaccaacatggtgaaaccctgtctctactaaaaatacaaaaaatagccaggcatggtggtgcgcacctgtactcccagctacttgggaggctgaggcaggagaatcacttgaacttgggaggtggaggttgcagtgagccgagatcgcaccgctgcactccagcctgggcaacagagcaagactccatctccaaaaaaaattatcttgtttttatcaatctttcttaaatgtatagctcacatttatttcaatgtttaaaatgagaaatatttggggtctttatttagacgtttgttgatgtttttgtgaccagaaatatgttacaagaacttaactcttgtttatatcaatcatcccatggcaaattggttttattaccagtagtgttgcttaaagtcacagtttccaagaatctatccatgataaatgaggacttactggacttaatagtactgaattgtacacataaaaatggttaagatgataaattttatgttatgtgtattttaccacaatttttaaaaatgaaaaaaagaaatcctggggaatgatatgttcaaagaaggctttgaaaagctctgatatattccagaaatctagacagctacacaggggcagggctttgtgcgtggccatgaaagacctgaggcagctgtaatgttttacatttgactctggggttctgtgccatcagaaagtgaaggctaaagcagacttggactgccagagtgttgaagatgtgtcccagcacatacaaagccactctacaaaggctgggagacataggttcaaggcatttaaggaaatctctatctaatcattagctgaccactcagcacactaagcaaagactgaaagacacatgacaaagaatacagacttcatagaattagtcagggaaagtcactaaaaaattcaacagcaacaacaacaaaacccttgagagggaagggtctggcttacagttaccacatcctagtctttaaaatattcagttttgagcaaaaatatgagatacacaaagaaacaaaagcccatgcagaggaaattctgagaccagctcgatcggggagaccctaacccagtggcactaggggatattaaagacacacacacacaaatatagaggtgtgaagtgggaaatcaggggtctcacagccttcagtgctgagagctccaaacagagatttacccacatatttattaacagcaagccagtcattggtattgtttctatagatattaagttaactaaaagtatcccttatgggaaacgaagggatgtgccgaattaaaggaataggttgggctagttaactgcaacaggagcatgtccttaaggcacagatcgctcatgctattgtttgtggcttaagaatgcctttaagcagttttccgccctgggcggaccaggtgttccttgccctcattccggtaaacccagagccttccagcctgggtgttatggccatcaggaacatgtcacagtgctgcagagattttgtttatggccagttttggggccagtttatggccagattttggggggcttgttcccaacaggaaaataaagaagtcaatggaaattctccatgaggaggcccagatgttatccttcctaggcaaagattttaaattagctattataaatatgttcagagaactaaaggaaaccatttctaaagactaaaggaatgtataagaatatctcaccaaatagagaatactaatgaagagataagaattagaagaaccaagtaagaaatgctagagttgaaaattacaaaactgaaatacaaaattcgctagaggcactcaacagcagattagagattgcaaaagaaagaaacagcaaacttgatgataggtacattgagattacccaatcagaggagcagaaagaaaaaagaataaagagaaatgaacagagccttagaaatctgtgggataccatcaaacaaatctggaagtcccagaggagagaacaagggggaaaaaaggcagaaaggctatttggagaaataatagccaaaattttccattaagcttttcatttgattaaaatttatatattttaaaaagtttaagtgtatcctactcatactttttaaagaggtccatacctagacacatcatagtcaaactgccaaaaaagagagagagaatcctgaaagcaccaagagaaaaacaattcatcttgtataagagatcatcagtaagattaacagctggcttcttgtaaaaaactcacagagaacaaaatgctgcagaatgacatacttgggaaggcagtggggtggagaagcatgccaactaagaattgtatatccagctaaactagccttcaaaaaccaaagaagaaaaataaaaaaaaaatgagatattcccaaattaataataaacaaataacactgagataatctgtcattcatagatctgccttatgagaaatactaaagggcctcctctttcaggctgaaataaaagaacattacacataacttgaatctacagaagaaaaaagagcacggttaaaagtaactacataggtatataaaaatgatagtataaatgtatttttgtttgcttgtaactcattctctctgatttaaaggacaactgcaggaaacaataccaataaaaatgttttgacaatgttatatgaaaatttaatttgcatgatggtaataccacaaataagagggatgggaatagagctatattggagtaaagtttttgtgtatgatttgaattaagttggtattaatctgaactagattgttttaaattaagatgataactgaaattaaatgttaattgaaaggcagtcactaagaaaatagagtaaaagaaacaaataaataaaatggcacttaaaaatatctaacagtaaagaaagcaataatggagagcaaaatgacttgaaacatacagaaaataaagagcaaaatgacaggcacaaatcctaccatatcagtaattaaatgtaaatgaattaaacattctaataaaaaaggcagagattggcaaaatggattaaaacacaaaacacagacagaaacagcaaccattctccaattatatgaggagacctgctttacattcaggaaaacaaataggttgaaagaaaggggatggaaataaatatactctgcaaacagtacccaaagacagctgaagtggctatataaacaccagacaaaatagactttaatgcacgaattattagagacaaagacattttataatcaaagggtcaatgtatcaggaagacataacaattataaacatatatacctctgacagtagagcaccaaagtaaatgaaacaaaaactaacttaaaaagagaaatacacaggtcaacaataaatgttggagactttaatatcccactttcaataatgaacagatctaggcagaagatcaacaaaaaatagaagacttaacactatgaaccaaatagacctagcagacatctgtataatactgcatccaacaactgcacaatatatattcttcaaatacacatgaaagattctctaggatagaccatgtgttaggccctaaaacaagtctcaataagtttaaaaggactgaagtcatacaaagtatgtcttccaaccacaataaaatgaaattagaaatccataaaagaagaaaatgtgagaaattcacaaataagtagtaatgaaacaaaataacctatgggataaaaaggaaatcacaggggaaattagaaaatatgtagagattaatgaaaatacaccatgtcaaaatttatgggacacaggacagtgttgaaaaggaaatttacagctgtaaacacctatatttaaaaagaaagattttagttcaataatctaaacttctaccattagaaatgaaaaaggaaatgcaaacaatctaaatcaagcagaaagtagaaaatagcagagattagggtggaaataaatggaagacccaaaaaacagagaaagtaataaaatcaaaagttggttattgccgaaaccagcttggctggggagaccctaacccagtggcactagaggaattaaagacactcacacagaattatagaggtgtggagtgagaaatcaggggtctcacagccttcagagctgaaagcctcaaacagatttacccacatatttattgacagcaagccagtgataagcagtgtgtctatagattatagattaactaaaagtattccttatgggaaacaaagggatgggccgaaataaagggatgggtctggctagttatctgcagcaggagcatgtccttaagggacagatcgctcatgctattttttgtggtttaagaacacctttaagtggttttccgccctgggtggtacaggtgttccttgccctcattccgataaacccacaatcttccagcatgggtgtcatgaccatcacaaacatgtcacagtgctgcagagattttgtttatggccagttttgcggccaatttatggccagattttgggggcctagtcccaacgtgtcccccttctttgatttgcaaagtgataaaagcaaaggcagttttgtcacggtgagctacttcttgcaggagtcaggatccgcatctgcagactatacaaaaacaacatagattaaaagcacaatcatcatcgaaatcacagagcttccaagtgttttcatccattttaatgggttgctagctgcttatctgtctgcagctcctttaagcactccttttcctggcattaaggtcaggtgtgcctaggatgctttatttgttcttttaattttgcaatatccaaaaacaagcttgtagagtgtccttctagatgctttttaaattccttcccaaattttgatctaattaagagctattaataatttccacaaatccttatttaagctcctagagtgggccatatcatttgaggttgaggtgccactataccgccatggttccagatgataggaactcttgccatgtcttatcatttctaccatctgaccattttgttcagaccagctgaacatagtgtggctgtggcatgcagactgagaggtgcaattcaagccaaacatccccttaggggaccaatcaataatgattccataggaagcattgtgcagcacctctgcctgttctgcaatgcagtcttcctaaacaagtacattcattttttctaactgggtccaatcctgtttacaaataggtttttgagggcagtatgccttaattataggagcagatttattatggtaaatactgagatcagaaagcatgtgtaagtgtgtcatagagtgattacatccaggcattattgccagccaagattgataactatgcccaataagtacagttgttctctgtgtcagcacttgttgaaggaatactcatggcaatggtgatcaccgctgtcatagctaccattaaattactcactgtgactggttgtcctgctttcctcaggttttcttctgccaactgtgacagcttcttgatctgtccccaagtgggtggctgtgtttgatgggtgttgctcgtgacagttggggtcctcctcagcatcagtcttgagatggctgcaaccagggggtcctcaggatcctcctggaatctcttcctcagcatctggctcatgataaggtttcaggtatcttgatggtatccaaatcagctcttgattttggcctggagaaacacaagcataacctctaccccaagttattattttacctatttcccaaccttttgttatgcaaagtgagaaaaggtgtgcacacatacatgtaacgtgtgacatccatttgccaaagataattaggttccaatcctcgaggattaactcctcctgcaaaagatgaggaatgcaccatttggcaagttgggcatcactggatcataactttagcttctttccaggtaatgctgtatctgtgtttcagaccagaggcattaacatgggttaaattgtgaaaatgtctagcagtagatattgctttagcaactaggtgatcagccatttgattcccttcagtcaaaggtcctggaagaggtgtatgagccctaatgtgagtgatgtaaaaagggtgcattctactcctaactgctgtttgcaactgggtaaataaagtcattagtgtcatctgtttgaaattgtaactgagcattttcaactaactgtgtggaatgaaccacgtatgaagaatcagaaatcatattaatagacatattaaaagcagtcaatacctcaattacagctacaagctctgctgttagagctgaagtatagggtgtctggaaaactttaacttttgagccagaataagaagctttaccattactagacccatctgtgaaacaatgaaaatgcttagcaggctgcaagttgtttactgcaggaattataaatgtaaaccattcacagtcttgcttagctaaagtgatagtaaagaaacagtcctttaaatctgtgacaattaaaggccaattttttggaattatagcaggagaaggcaatccaggaggctgtaatgctcccataggttgtataactgaattgatagctattaagtcagttaacattctccatttacccgattttttcttaattatgaaaactggagaattccaaggggaaaatgctggcgctatgtgcccattttctaattgttcagtaactaattcctctaaagcctccagtttctctttacttagcggccattgttctatccaaattggcttatctgttaagcattttaaaggtgtaggttctggaggcttaacagtggccgccatcaaaaatgatatcctacaccttggcgggaactttgtctttacgcttgaagcggttccttcaaaccttgcaatttttttcctagtcccataccagggacatgccccatttcatgcatcatatgttgactttgagggctatataattgttctggaattagaacttgtgctccccattgttgtaataaatctcttccccataaatttgtaggtacagaagttataattggttgaatagtcccaggttgtccatcgggccttcacaatgcaaaatataactactttgatatacttcaggggctttaccaactccaactatgttaaattgagcgggtggaattggccacgcaaacagccagtgctgtagagaaatgattgaaatgtctgctcctgtatctaccaaacctttaaatttctttccctgaatagttatttcacaggtaagatgtttatcagtaatttgatttacccaataagcttctttgccttgtttatttgtgctttcaaatcctcctgttcgtttaatttaacttttccgtatttctacatacggcacaatcaggagctgtgctataagctctcctggctctgctttccagggaacagaagtggatataacaatttgaatttccacattgtaatctgaatcagtgactcctgtttgtacttgtatcccttttaaatttaaactagaccttactagaagtaatcctatcatccctgctggcaatggtccacagactcctgttgggaacttttgtgggggttccccaggcagaaggctcacagcatttgtgcagcataaatctactgcagcagtaccagctgtggcaggggacaaacattgtaaatcccatgaagtatatggggtattagtgcattcatttagagctgagggctcttaggtggaagatgttaataaactgtccaggtcccatggttcagcagagcattttccattgctggggcccttagggatctccaggatttatcccagagtgcccataatggacagtacaaaagtgggaagagtttccaagaaagcaaataccccatcatccaccacaaaacacactctcagcttattcatcaatgtggcactggggtccttaatgtgtggcaggcagaggtaatgacagtgagcaaatagcccagggattacttgagctaaaagcaacaaaggaaccaaacgcttcgactttctgaccaaactcagttcccaactgaagctggtctcatgcaagtgtgctggcctgagtgatctcacatcctgtgaaggctctgccaaggagggatggtggctagggtcaggcctccttaagaggggtcccggatcctaccagaggctaaggtgggaggatcgcttgagcccagaagtttcagagcagcctggacaacatggagagaccctgtctctgcagaaaaaaaattagcagagcatggtggcaggagtgtttaatgccagctactcaagaagcagaagtgggaggattgcctgagcacagaagtaccaacctgcagtgagctatgattgtaccctgacactccagcctgggcaagagagtgagaacctgtctcaaataaagaaaggaagaaaggaagaaaggaaggaagaaaggaagaaaggaaagaaggaaggaaggaaaaggaaaaggaaagggaagaaaaaggaagggaagcaaagggaggaaggaaggaaggaaggagaaagaaagacaaacagagaaaagaaagaaaagaaagaggtgctttggagaaacccacagaagacttttacactttagttgtgttttgaatacttaaatccaacatacaaaggaatagaaattatattcttcacaattatgatttttcttttctttctccctttttttttttttttgagacagagtcttgcttcttcgccgaaactggagtgcattggtgcgaccttggctcactgcaacttctgcctcctggtttcaagtaattctcctacctcagcttccccagtagctgggattaaaggcatgtgccaccacacccggcaaatttttgtatttttagtacagacagggtttcttcatgttggtcaggctggtctcgaactcccaacctcaggtgatccgcctgcctcggcctcccaaagtgctgggatttaaaggcatgagccaccgtgcccggccaggtctcagattttttagaaagtttattttgccaagttggaggatgcgtgcctgtgatgcatcctcaggaggtcctgacaacatgtgcccaaggtggttggggcacagcttggttttatatattctagggtgacatgagacatcaatcaatatgtgaaagatgtacgttggttcagtccagaaaggtgagacaacttgaagagaaggccaaacagggggcttccaggtcataggtagaaaagagaccaatggtttcattcttttgagctgctgattaccctctccaaatgaggcaatcagatatgcatttatgagcagacaggtggctttggatagaatgggaggcaggtttgccctcagcagttcccagcttgacttttccctttagcttagtgattttgggtccccaagattgatttttcttttgtaaggtctaacatggtttcctatgagcattaattattcattgtgtattttattacaaaaataaggcacagattttttaaaaaacatcaatttcatgactagttatatacacataattacactgaagttcaactaaatttggaaacattccagagtttgggtttctaataattctttgtgattctttagaagctaaaatattttaacaaagcaacatctaaaatcacctgtagaatgtcctgccatttttgtttctctagtttcctcattttctgcaaagcctcgctgaggaaattgactctgaatatccttttacactcttctgttttagaaagcattgtggtgaaacattgaatcataatggtcacaagttctgttcacattctttctttctttgaatattttttcccagtggccaatatttgattctgttgtattatgggtaaaaggtaggcatgagaacaaaataaagacaagaggtcttttgaataagtgatccagtcacaatgaatcaatttgccattggaacatatttttacgtcactcttctgaaaatatttagccatgaattgaaagagagtctgtaagattatttttttcctgttctaaggtgaacagcattttagagaatgaaccacaaccacagcacaagaaaaaaatctgataaataagtttacacatatgtgttactactgtaacataaaacatgtaaagagcatttgttttgatttatatatcagtctgtattgtttaattttttgtgtcataaatgctcttatttaaaagacaggactatttaacagtgtaaattactagtaattcatggtataaataattaaacaaggaagtgttcaaaaatataacaatgttttaaataagcccattttgtgcttctgtaacagaatacctgaggctgggtaatttataagtaaaaaacgttcatttggttcacaatactggtggttggaatgtctgagattgggcagaggcatctggtggggcctcagtctttttcacctcatggtggaaagtggaaggggagcaagggagtgcaccagagatcacatagcaagagcaaaagcaacagtgaagccaaggaagtcagactctttttaactacctactcttgcaggaattaatccattcctgtgagagcagaactcactcacctctgtggaggacaataatctattcatgaaggatccatcccatgacccaaacaccttccactaggccccacctccccacactgccacattgggggtcaaatttcaacatgagattttgcagggacaaaccacatcgaaaccttagtaatttgtagcatagttaaattctttttcacatgatgtattctgtgctgggatactccacatcctgaatattttaatttaatttgaatagagtttgatttacccattttgctgtaaaattccgtgtgttttgacaaatgcatagttgcaggtatccattattaaagaatcatatggaatgcttcaaatccccaccccatgcagccaatggcattcccatctgtgcagtttgccttctccagaatctcattaaatgaggtcacactgtgtgtgttctcctcagactgtcttcttccactcagtaatgtgcatgcaagattcactcatgtctttgtgtgagttgatagcttgttcctttctatggctaaatagtattccattgcatgaatgtaccacaatttggttatgcattttagggagcaaaaccttcctcttctaactttgttccagggttggagaccttcaaattaactgacaatagatacattagtaggagaggcaatacttggcttcttattccacaagtatcattgtgggacaaaattcatcagatggcaggatctagtttacaaagaggtgaaaatagcccaaaacgagaaacaagactagaatctgataacccacaagggctatagttttcctttttaaaaaaatttttttttgagacagagtctggctctgtcgcccaggctggagtgcaatggtgcaatcccagctcactgcaacctctacctcctgggtggaagcgaacctccctcctcagcctcctgattagctgggactacaggcacatgccatcatgcccagctaatttttgcagttttagtagaggtggggttttgaactcctggcctccaaaagtgctggaattataggcttatgccaccatgcacggctgagttatagttttccattgaaacataaaatttctctctgtagtaaccatcatttttgatcatagataatcaatgtgagattattcttgttttaaaaataagtctagtttcgttagattttgcctgagtatttatgtaagtgcagcaagaacaggaggtgaccacgtaggtgctttcaagcttcttcgctggaagttttcatacagaatctcagattggacttttaaaggccttattgaggctaaaagccaagccaagaacatactttcaaatttcagctgcagtcattgtagctttatgtgaattcctctcttcttgacgcccccaaaatatccccaaattcctgggcctagcaggaaattaccttctttactaacctgtaaggctgtgaaccgtgtaatgtaggtaccaggctggcttttctcaaagtgctttgtaagcattggcttcataaaagtcagccttagttccttaaaattgctggtcataactgatctcaggtatactattcctaaatatgatattccagtaaaagcctgataatataatcaaagtttccaattatgtcttgctataaggtgaacagatgcttattggacttctgctaacaactatattgtcatgaaaataagagtattcagtaagattttcaaaattctggagaaatcaggcagggaaaaaaagattttttttttttccccacccagcctcatttctgtttacaaaagtataatctactaaatttttgtgagttatagttagcttaagagaaagagatttcttaaatccagaaactagaacattaaagaaccagcagtactccaaaaaagctataaaattataatcaattttcatcacttcattcagtgccatgtaatcaattccagtcttgctggatcttgggttagcagtgtcacgaacccatcgatttctcaaccagacttctggagatcttcactgagtcaagtgtatggtcttaaagttatttaagcaatatcatcagaagcctacaaccagagtacctgtcataggctttttcgtgagtctcagagcgagtcctgtgttggagacaaacattctgacctgtagctgattgcaggagctttcaggaaagtatcagggggaaatagtatctaaatgccaaagagtatgaaatggctgtgatgaaaggtcagatgagagttcattataccacaactgacaaggatattcgatttttttggtggcatacaacgtttaaaataataattgaaattatgactcaaaacagtataccggcacatagcatggataaggaggacattgacaaatttccagtaattttatacaatttctgaaaacataacattttatccatacaaatataacccagggaaggttaggtatctctttttattttatattttgtatggtttttcttataaaaa

SEQ ID NO: 588 - DNA, 140118 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgcccaacgccctgccgcatccactggttcttccgttgtttaaagacgcgcggctgcgcatgggctgtcgagagagcggcgggaggcactacagcgcccctggaggcccggagggagaacggcccggtcccagttgtgcagggtagccggatccatccatcttgctggaagggaggggggagagcagctccaagaaaggcttctctgcttccaactacctccacccctcatctactgaattatgaacgccttgctccaagtcaccccacctatttggcctccacctccacagacgtttgaggcagccctaggggctgttcccaaaattttgggttctggggctggactaggtgaacaccacagcagccagcaggagccacagcatttattctacagacgccaaaggctgtcaaaagagccagcccctattgggaagagggatagagatcatgcggcattaagtattgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgctgggttaggaggggctctttaaaggtcccaagattcaaatgttcttgtagcagatgaagagctcttggctggacggatggatccagtgggagcctcctccttccccactcagttctttacatccccgaggcgcagctgggcgaaggaagtggccagctgcagcgcctcctgcaggcagccaacgttcttgcctgtggcctgtgcagacacatccttgccaccacctttaccgtccatcaagcctgacacctgctgcacccactcgctggcttttaagccccgattggctgcattctagaagacaggaagggaagggggagtcagcacagaagatgggattgagggaggaatgcagggaaagaaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggaacttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgcagggagctgctgctcctcccaatctcaatcccagaccgtgggcccttaggcaaccacttcgctcagagccacagaggccacatgtcagccaccagagagctgatgagccctaggggaggggaccctggcccctgggttgccttggctgaggcgccgctctccatctccaggatgacaagaggctggttggggttgctgtcgatgaactgcttcgtcttctctaacacctgcaagaaaaaagtccagaacagcagctcagaccaaaagcccaggccccgaacccctggctgttctgccagcctttgcctaggaaacactctggccactggtgctgccaggactcactcgtttctggacatcggctttgctggctcggtccaagtcatccatgaccttctttagggatttgagagtctcccgcaattcatccttctgccactgggggatgactgcagtggccagggcctggaaccaatagacgaccatctcaatctgggccacaacttgctgggatgtcagggtccagcccaccccacccgaacccaagtcctccctgactagtgtcctggaaaggaaagcaaggaaagctttgagaccagtccctttaggagcagctgtggcaggtgaaacaagcagggctagagagaaaggagcagcagaaagctgggctcccaaatcaggcccggtccttaccaggctgggaacagcctgtgataagcttcctggcagcttgaaatgcaaataaataccaggcaggcttggaagcaggggccagccttagcccattccccaaatccctccaccccagtgcccatacatgcttgggaagagctctcctgctagcagcactgggagcagcagggaatgtccagggtccaaggacaggatccatggggtccctgctacaaggctacaggacaacagaagtcagcccaaaggcccattccaccaagaaccagggcctgactgactacagatgatttcctgaagacggggcatgtttcatgcaccaggccctgaggacggagggagggaagccgcccctacctctccaaggtcagcgatctccctctgcacatccttgtttggagcagtctgagccttcactttggcttccatgacagagagacatttcttcaagctctctgctttcctgagggcctgggaggggacaccgggtcaaccccaagcaggaggtctgagtcagactcactatcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggtggcaggtttcttctgccactcaggggtaggacactggggcagggggagtggcccagcctgtactttcactctgactgcagcagccacgcagagcagtgtttgctctatggattcgcagactgggctcctcttgccttcttcagataagccacaaaccagcctgacctgctcaccttctgggcctcggcacctgtgacagccacaatcctccggatacccttggcaatggcttcttccgtcacgatcacaaaagctcctgcatgactcgagttccgcaggtgcctgaatggcagaacacaaagtccatagtgaaagaggccctggcagcccttggctggggggtcacactagcggacaagagaagcaggaatgggttgacagtcagggaaagcctgggcttgagagtattctgacaccaagcgggacaccagctcgctgagcctgagtgttctcagttctcaaatggggatgattctccccacacagttgctgtgaaaatcaaatgaggtaaacatgaaagtgctttgtggtccctaatatccaatacagtcttacccttaggctctacgtgacagttttggtcttgtagtggaacttaagctccatttttgtattctgctcactaggtgacaattttggaggattacttttaaaatcttaccacaaccccttaaacaggctttatttctcagttcagagaacctcaaatgttcattaattcatcctcattctttgaagatagtatagttttttttgtttgtttgttttgagacagagtcctgttctgttgttcaggctggagtgcaatggtgtgatcttggctcaccacaacctctgcctcccagtttcaaatgattctcttgcctcagccacccaagtagcttggatacaggtgcccgccaccactcctaatttttgtatttttagtacagacaggttttcaccatgttgcacaggctggtcttgaactcctgacctcaagtgatctgcctgcctcagcctccctaagtgctgggattaaaggcatgaggcaacatacccaacccttggtataaagtttttgaaagctgtttcctgtagtctaaagggtatgagcaaacaggtaatcaggcaaagtgggactcgtttgaaggcccaattcagctgggcagaaaagccttgaactcaatcccccaggcccctatcctactctctgcacatcctacttgctccctgcctgccagaggcctgcaggagaccctggagggtctcaaccatgacattaagaatgttcttttcagccgggcgtggtggctcacacctgtaatctcagcactttgggaggctgaggcgggtgggtcacctgagatcaggagttcaagaccagcctgaccaacgtggagaaaccccctctctactaaaaatacaaaattaggccaggcacggtggctcacacctgtaatcccagcactttgggaggctgaggtgggtggctcacgaggtcagaagatggagaccatcctggctaacagggtgaaaccccatctctactaaaaatacaaaaaattagctgggcgtggtggtgtgtgcctgtagtcccagctactcaggaggctgaggcaggagactcgcttgaaccctggaggtggaggttgcagttagccaagattgcgccattgcactccagcctgggcaatgaaactccgtctcaaaaaaaaaaaaagaatgttctcttcatggctgggcatgggggcacatgcctatagtcccagctacttgggaggctgaggcatgagaatcgaagccaggaggtagaggttgcaatgagccgagactgtgccactacactccaccctgcgggacagagcaagactccacttcaaaaaaacaaacaaaaaaaaccacaattcttttcacaaggcttcatttggaagcagaaactttccaggccaccatgaccttcccaaaaaggcccagagagatacagaggaatccaaattggcagaagtggctatcccaagccaaactgagctgagtcaaccacgtggcctgctcgggggctctgagacaatggagctacattccccagatgccgcccaagctgtcaaaggaaattaggtgagataccaggaatgggaagggctaggcccacatcaagagctcaacaagcactccaggccttgctgaatcccaaattcacacaagccttcttgctagtttcagcccagcaaacaacagcaagcaactgtgtggtaatgtgaatacaatgttttcccccttttcctcctgggaatgtttcgtcaggaaatgttaccttcagatacagggatctaatgagcatgctaggatgctgagattcttgggaacgctatttagcaacggcatttctgaggacttcacttcaaccttagacagacaagagttggtccagcctaagacctacatcctcagaggatgaaggtagatgacctgtctactctgcccctctgcagtactcacgttcccccacagaactcaacagaagtcagggagccagcaggcccagaggggtcatccagcaactcggacaccgggaccccaatggagacgactcgcacagggtcaggataggtctcatcaaacacagcccgtaggccctggatggctttcgctgctgccagggggcaatcctgggtatagacggcctgccagaccaagaagacagaaaagagctggaagagatccctggaggtgcggtacgacgaggcaggaaagcatggtcctgcaggcaggactcgggttccaacctggcttggcctagcacgtgccatgagcttcctcaatcacacgccacgtgcaaagtcaagggcatcagtatgggaatttccaactattttgttaaactgtggaccaaatctcatatgtgaacagacttaactagaacagctctggttctcccaaggtggggtgggacaaatgcctctccctctcccctccaccaaccaccaccactgcccccggcaaaagcacagatggagaatcactgctttaaacaaactttttttttttttgagacggagtctcgctctgtttcccaggctagagtgcaatggcgcaatctcggctcactgcaagctccacctcccgggttcacaccattctcctgcctcagcctcctgagtagctgggactacaggtgcccgccaccacgcccggctaattttttctatttttagtagagacagggttagccaggatggtctcaatctcctgacctcgtgatccgcccgcctcggcctcccaaagtgctgggattacaggcgtgagctaccgtgcccagcctgctttaagcaaatctacgtgcaggacgaatctgatacaacagagtgagagcaccgcactgctaagactgtggacagacagtgacggtgtggggagggggggcattcagccgtcgcccatcctaccttggctgcct
